(12) United States Patent
Li et al.

(10) Patent No.: US 10,364,473 B2
(45) Date of Patent: Jul. 30, 2019

(54) FAST DIAGNOSIS AND PERSONALIZED TREATMENTS FOR ACNE

(71) Applicants: Huiying Li, Los Angeles, CA (US); Shuta Tomida, Santa Monica, CA (US); Robert L. Modlin, Sherman Oaks, CA (US); Jeffery F. Miller, Santa Monica, CA (US); Sorel T. Fitz-Gibbon, Los Angeles, CA (US)

(72) Inventors: Huiying Li, Los Angeles, CA (US); Shuta Tomida, Santa Monica, CA (US); Robert L. Modlin, Sherman Oaks, CA (US); Jeffery F. Miller, Santa Monica, CA (US); Sorel T. Fitz-Gibbon, Los Angeles, CA (US)

(73) Assignee: THE REGENTS OF THE UNIVERSITY OF CALIFORNIA, Oakland, CA (US)

(*) Notice: Subject to any disclaimer, the term of this patent is extended or adjusted under 35 U.S.C. 154(b) by 0 days.

(21) Appl. No.: 15/257,423

(22) Filed: Sep. 6, 2016

(65) Prior Publication Data

US 2017/0058328 A1 Mar. 2, 2017

Related U.S. Application Data

(62) Division of application No. 14/385,576, filed as application No. PCT/US2013/032551 on Mar. 15, 2013, now abandoned.

(60) Provisional application No. 61/612,290, filed on Mar. 17, 2012.

(51) Int. Cl.
| | |
|---|---|
| *C12N 7/00* | (2006.01) |
| *A61K 39/02* | (2006.01) |
| *A61K 39/05* | (2006.01) |
| *C12Q 1/689* | (2018.01) |
| *C12Q 1/6883* | (2018.01) |
| *A61K 35/741* | (2015.01) |
| *A61K 35/76* | (2015.01) |
| *C12Q 1/70* | (2006.01) |

(52) U.S. Cl.
CPC ............ *C12Q 1/689* (2013.01); *A61K 35/741* (2013.01); *A61K 35/76* (2013.01); *A61K 39/0208* (2013.01); *A61K 39/05* (2013.01); *C12N 7/00* (2013.01); *C12Q 1/6883* (2013.01); *C12Q 1/701* (2013.01); *C12N 2795/00032* (2013.01); *C12Q 2600/112* (2013.01); *C12Q 2600/156* (2013.01); *C12Q 2600/16* (2013.01)

(58) Field of Classification Search
None
See application file for complete search history.

(56) References Cited

U.S. PATENT DOCUMENTS

| | | | |
|---|---|---|---|
| 5,836,999 A | 11/1998 | Eckhouse et al. | |
| 6,726,913 B1 | 4/2004 | Van Kampen et al. | |
| 7,005,257 B1 * | 2/2006 | Haas | C12Q 1/6841 435/29 |
| 7,867,711 B2 * | 1/2011 | Yoshii | C12Q 1/689 435/6.15 |
| 8,529,892 B2 | 9/2013 | Blaser et al. | |
| 8,906,668 B2 * | 12/2014 | Henn | A61K 38/13 435/243 |
| 9,011,834 B1 * | 4/2015 | McKenzie | A61K 35/74 424/93.1 |
| 9,011,885 B2 * | 4/2015 | Saurat | A61K 31/00 424/400 |
| 9,028,841 B2 * | 5/2015 | Henn | A61K 38/13 424/203.1 |
| 9,180,147 B2 * | 11/2015 | McKenzie | A61K 35/74 |
| 9,446,080 B2 * | 9/2016 | McKenzie | A61K 35/74 |
| 9,533,014 B2 * | 1/2017 | Henn | A61K 38/13 |
| 9,737,592 B1 * | 8/2017 | Bermudes | A61K 38/55 |
| 9,889,165 B2 * | 2/2018 | Taylor | A61K 35/741 |
| 2009/0035329 A1 | 2/2009 | Blaser et al. | |
| 2013/0224745 A1 * | 8/2013 | Hogan | C12Q 1/689 435/6.11 |
| 2014/0147425 A1 * | 5/2014 | Henn | A61K 38/13 424/93.41 |
| 2014/0199281 A1 * | 7/2014 | Henn | A61K 38/13 424/93.46 |
| 2015/0005373 A1 | 1/2015 | Saurat | |
| 2015/0086581 A1 * | 3/2015 | Li | C12Q 1/689 424/190.1 |
| 2015/0094351 A1 | 4/2015 | Saurat | |
| 2015/0152486 A1 * | 6/2015 | Mouyna | C12Q 1/6895 506/9 |
| 2015/0190435 A1 * | 7/2015 | Henn | A61K 38/13 424/93.46 |
| 2015/0361436 A1 * | 12/2015 | Hitchcock | C12N 15/746 424/93.2 |
| 2016/0074505 A1 | 3/2016 | Kovarik et al. | |
| 2017/0042856 A1 * | 2/2017 | Saurat | G01N 33/5088 |
| 2017/0058328 A1 * | 3/2017 | Li | C12Q 1/689 |
| 2017/0065647 A1 * | 3/2017 | Kim | A61K 35/66 |

(Continued)

FOREIGN PATENT DOCUMENTS

| | | |
|---|---|---|
| EP | 0914778 A1 | 5/1999 |
| WO | WO-01/81581 A2 | 11/2001 |

(Continued)

OTHER PUBLICATIONS

Li et al (An Unbalanced Microbiome on the Face May Be Key to Acne Development, Microbiology Society, Charles Darwin House, 12 Roger Street, London WC1N 2JU, UK); Barnard E, HPC—Household and Personal Care Today, 2017, Newsletter May, May 30, 2017 (Year: 2017).*

(Continued)

*Primary Examiner* — Nita M. Minnifield
(74) *Attorney, Agent, or Firm* — Foley Hoag LLP; David P. Halstead; Allison Gilder

(57) ABSTRACT

Methods of diagnosing and treating patients afflicted with acne, including diagnosing one as having acne if the individual possesses RT4, RT5, RT7, RT8, RT9, or RT10. Methods for treating acne include administering an effective amount of a drug specifically targeting RT4, RT5, RT7, RT8, RT9, or RT10, such as small molecules, antisense molecules, siRNAs, biologics, antibodies, phages, vaccines, or combination thereof.

8 Claims, 36 Drawing Sheets

Specification includes a Sequence Listing.

(56) References Cited

U.S. PATENT DOCUMENTS

| | | | | |
|---|---|---|---|---|
| 2017/0151291 A1* | 6/2017 | Henn | ............ | A61K 35/742 |
| 2017/0165302 A1* | 6/2017 | Henn | ............ | A61K 35/742 |
| 2017/0304373 A1* | 10/2017 | Taylor | ............ | A61K 35/741 |
| 2018/0078588 A1* | 3/2018 | Taylor | ............ | A61K 35/741 |
| 2019/0008930 A1* | 1/2019 | Modlin | ............ | A61K 38/47 |

FOREIGN PATENT DOCUMENTS

| | | | | |
|---|---|---|---|---|
| WO | WO-03/033515 A1 | 4/2003 | | |
| WO | WO-07/056680 A2 | 5/2007 | | |
| WO | WO-09/105592 A2 | 8/2009 | | |
| WO | WO-10/065735 A2 | 6/2010 | | |
| WO | WO-2011149099 A1 * | 12/2011 | ......... | A61K 31/7088 |
| WO | WO-2013/142378 A1 | 9/2013 | | |
| WO | WO-2013142378 A1 * | 9/2013 | ............ | C12Q 1/689 |
| WO | WO-2015/195845 A1 | 12/2015 | | |
| WO | WO-2017136738 A2 * | 8/2017 | ............... | A61K 8/36 |

OTHER PUBLICATIONS

Sorel Fitz-Gibbon et al, Propionibacterium acnes Strain Populations in the Human Skin Microbiome Associated with Acne Journal of investigative dermatology, 2013, 133/9:2152-2160, published online Feb. 28, 2013. (Year: 2013).*

Jahns et al, Simultaneous visualization of Propionibacterium acnes and Propionibacterium granulosum with immunofluorescence and fluorescence in situ hybridization, Anaerobe, 2013, 23:48-54, Available online Jul. 27, 2013 (Year: 2013).*

Johnson et al mSphere, ( Molecular Biology and Physiology, ), 2016, vol. 1, Issue 2, e00023-15, 12 pages published Feb. 10, 2016 (Year: 2016).*

Agak et al, Journal of Investigative Dermatology, 2017, (www.jidonline.org), 9 pages, published online Aug. 31, 2017 (Year: 2017).*

Yu et al, Journal of Investigative Dermatology, 2016 (www.jidonline.org), 136:2221-2228, published online Aug. 10, 2016 (Year: 2016).*

Alexeyev, et al., "Shooting at skin Propionibacterium acnes: to be or not to be on target," J Invest Dermatol, 133(9): 2292-2294 (2013).

Bojar, et al., "Acne and Propionibacterium Acnes," Clinics in Dermatology, 22(5): 375-379 (2004).

Brzuszkiewicz, E. et al., "Comparative Genomics and Transcriptomics of *Propionibacterium acnes*," PLoS One 6:e21581 6(6) (2011).

Craft, et al., "Response to the commentaries on the paper: Propionibacterium acnes strain populations in the human skin microbiome associated with acne," J Invest Dermatol, 133(9): 2295-2297 (2013).

Eady, et al., "A distinct acne microbiome: fact or fiction?" J Invest Dermatol, 133(9): 2294-2295 (2013).

Fitz-Gibbon, S. et al., "*Propionibacterium acnes* Strain Populations in the Human Skin Microbiome Associated with Acne," J. Invest Dermatol., 133(9):2152-2160 (2013).

Grice, E.A. et al., "Topographical and Temporal Diversity of the Human Skin Microbiome," Science, 324(5931):1190-1192 (2009).

Kasimatis, G. et al., "Analysis of Complete Gemones of *Propionibacterium acnes* Reveals a Novel Plasmid and Increased Pseudogenes in an Acne Associated Strain," Biomed Res Int., 2013:1-11 (2013).

Li, H. et al., "Metagemonic Study of the Human Skin Microbiome Associated with Acne," Nature Proceedings, Posted Nov. 22, 2010.

Lomholt, H.B. et al., "Population Genetic Analysis of *Propionibacterium acnes* Identifies a Subpopulation and Epidemic Clones Associated with Acne," PLoS One, 5(8):e12277 (2010).

Marinelli, L.J. et al., "*Propionibacterium acnes* Bacteriophages Display Limited Genetic Diversity and Broad Killing Activity against Bacterial Skin Isolates," MBio, 3(5):1-13 (2012).

Marinelli, L.J. et al., "Propionibacterium Acnes Bacteriophages Display Limited Genetic Diversity and Broad Killing Activity Against Bacterial Skin Isolates," Poster (2011).

Marinelli, L.J. et al., "*Propionibacterium acnes* Bacteriophages Display Limited Genetic Diversity and Broad Killing Activity Against Bacterial Skin Isolates," Poster 2012.

McDowell, A. et al., "A Novel Multilocus Sequence Typing Scheme for the Opportunistic Pathogen *Propionibacterium acnes* and Characterization of Type I Cell Surface-Associated Antigens," Microbiology, 157:1990-2003 (2011).

McDowell, A. et al., "An Expanded Multilocus Sequence Typing Scheme for *Propionibacterium acnes*: Investigation of 'Pathogenic', 'Commensal' and Antibiotic Resistant Strains," PLoS One, 7(7): e 41480 (2012).

McDowell, Andrew et al. "The Opportunistic Pathogen Propionibacterium acnes: Insights into Typing, Human Disease, Clonal Diversification and CAMP Factor Evolution," PLOS One; 8(9): e70897 (pp. 1-22) (Sep. 2013).

Nakatsuji, T. et al., "Antibodies Elicited by Inactivated Propionibacterium Acnes-Based Vaccines Exert Protective Immunity and Attenuate the IL-8 Production in Human Sebocytes: Relevance to Therapy for Acne Vulgaris," J. Invest. Dermatol., 128(10):2451-2457 (2008).

Nakatsuji, T. et al., "Antimicrobial Property of Laurie Acid Against *Propionibacterium acnes*: Its Therapeutic Potential for Inflammatory Acne Vulgaris," J. Invest. Dermatol., 129:2480-2488 ((2009).

Tomida, S. et al., "Pan-Genome and Comparative Genome Analyses of *Propionibacterium acnes* Reveal Its Genomic Diversity in the Healthy and Diseased Human Skin Microbiome," mBio, 4(3): e00003-13 (2013).

Extended European Search Report issued by the European Patent Office in corresponding Application No. EP 15788711.8, dated Nov. 21, 2017.

Nagy et al., "MALDI-TOF MS fingerprinting facilitates rapid discrimination of phylotypes I, II and III of Propionibacterium acnes," Anaerobe, 20:20-26 (2013).

Extended European Search Report for EP Application No. 17002012.7 dated Jun. 4, 2018.

Farrar et al., "Genome Sequence and Analysis of a Propionibacterium Acnes Bacteriophage," Journal of Bacteriology, 189(11): 4161-4167 (2007).

GenBank Accession No. AE017283.1, Propionibacterium acnes KPA171202, complete genome, Nov. 21, 2011.

Leyden et al., "The Evolving Role of Propionibacterium Acnes in Acne," Seminars in Cutaneous Medicine and Surgery, 20(3): 139-143 (2001).

Miura et al., "Quantitative PCR of Propionibacterium Acnes DNA in Samples Aspirated from Sebaceous Follicles on the Normal Skin of Subjects With or Without Acne," J Med Dent Sci, 57: 65-74 (2010).

Shu et al., "Fermentation of Propionibacterium acnes, a commensal bacterium in the human skin microbiome, as skin probiotics against methicillin-resistant *Staphylococcus aureus*," PLoS One, 8(2):e55380 (2013).

Eady et al., "Propionibacterium acnes resistance: a worldwide problem," Dermatology, 206(1):54-56 (2003).

\* cited by examiner

\* CRISPR spacers that match to the sequence in locus 2, which is highly homologous to the sequence in *Clostridium leptum*.
\*\* CRISPR spacers that match to the sequence in locus 3, which is highly homologous to the sequence in *Clostridium leptum*.

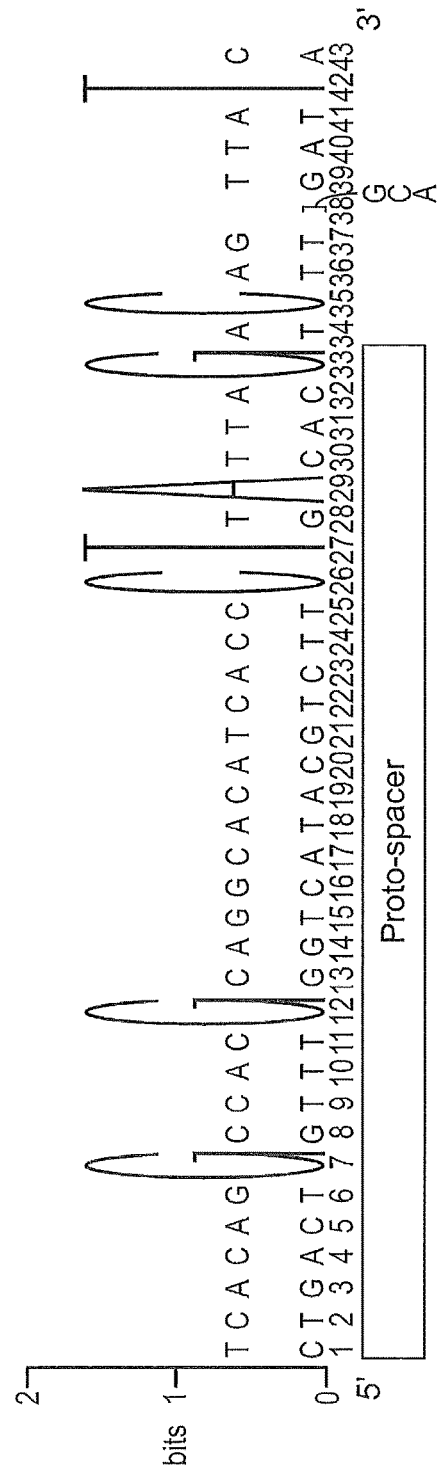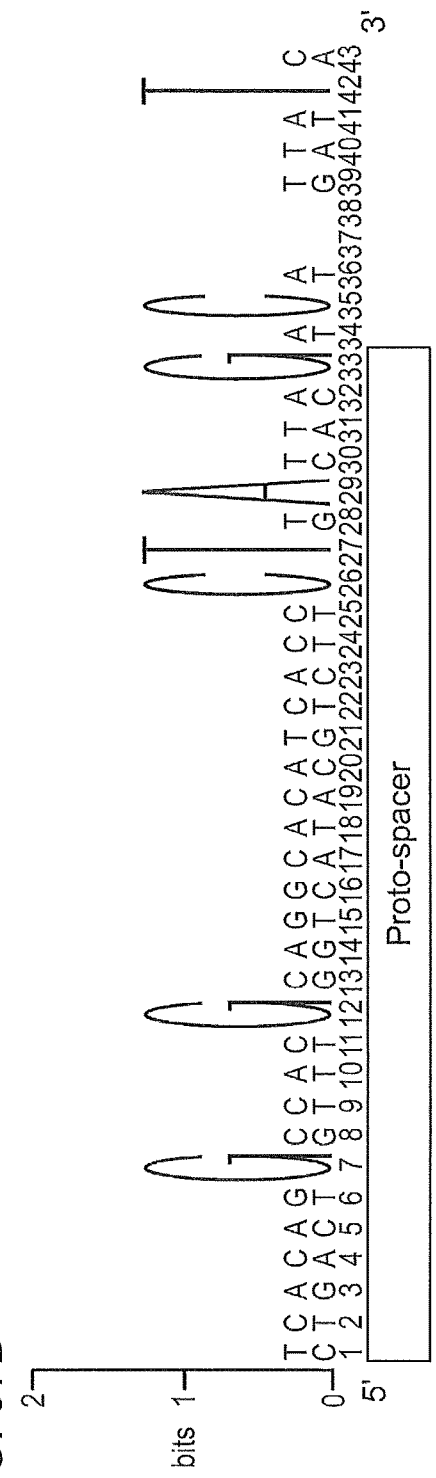

FAST DIAGNOSIS AND PERSONALIZED TREATMENTS FOR ACNE

CROSS-REFERENCE TO RELATED APPLICATIONS

This application is a divisional application of U.S. National Stage application Ser. No. 14/385,576, filed Sep. 16, 2014, which claims priority to International Application No. PCT/US2013/032551, filed on Mar. 15, 2013, which claims priority to U.S. Provisional Patent Application No. 61/612,290, filed on Mar. 17, 2012, each of which is incorporated by reference herein in its entirety for all purposes.

STATEMENT REGARDING FEDERALLY SPONSORED RESEARCH

This invention was made with government support under Grant Numbers AR057503 and GM099530, awarded by the National Institutes of Health. The government has certain rights in the invention.

BACKGROUND OF THE INVENTION

Acne is a skin condition that causes pimples or "zits." This includes whiteheads, blackheads, and red, inflamed patches of skin (such as cysts). Acne occurs when tiny pores on the surface of the skin become clogged. Each pore opens to a follicle. A follicle contains a hair and an oil gland. The oil released by the gland helps remove old skin cells and keeps your skin soft. When glands produce too much oil, the pores can become blocked. Dirt, bacteria, and cells build up. The blockage is called a plug or comedone. If the top of the plug is white, it is called a whitehead. If the top of the plug is dark, it is called a blackhead. If the plug breaks open, swelling and red bumps occur. Acne that is deep in your skin can cause hard, painful cysts. This is called cystic acne.

Acne is most common in teenagers, but anyone can get acne. 85% of teenagers have acne. Hormonal changes may cause the skin to be more oily. Acne tends to run in families. It may be triggered by hormonal changes related to puberty, menstrual periods, pregnancy, birth control pills, or stress; greasy or oily cosmetic and hair products; certain drugs (such as steroids, testosterone, estrogen, and phenytoin); or high levels of humidity and sweating.

Various treatments exist for the treatment of acne. In general, acne treatments work by reducing oil production, speeding up skin cell turnover, fighting bacterial infection, reducing the inflammation or doing all four. These types of acne treatments include over-the-counter topical treatments, antibiotics, oral contraceptives and cosmetic procedures. Acne lotions may dry up the oil, kill bacteria and promote sloughing of dead skin cells. Over-the-counter (OTC) lotions are generally mild and contain benzoyl peroxide, sulfur, resorcinol, salicylic acid or sulfur as their active ingredient. Studies have found that using topical benzoyl peroxide along with oral antibiotics may reduce the risk of developing antibiotic resistance. Antibiotics may cause side effects, such as an upset stomach, dizziness or skin discoloration. These drugs also increase your skin's sun sensitivity and may reduce the effectiveness of oral contraceptives. For deep cysts, antibiotics may not be enough. Isotretinoin (Amnesteem, Claravis, Sotret) is a powerful medication available for scarring cystic acne or acne that doesn't respond to other treatments. However, isotretinoin has many side effects, such as dry skin, depression, severe stomach pain, and muscle/joint/back pain, and can cause birth defects in babies whose mothers use isotretinoin. Oral contraceptives, including a combination of norgestimate and ethinyl estradiol (Ortho Tri-Cyclen, Previfem, others), can improve acne in women. However, oral contraceptives may cause other side effects, such as headaches, breast tenderness, nausea, and depression. Chemical peels and microdermabrasion may be helpful in controlling acne. These cosmetic procedures, which have traditionally been used to lessen the appearance of fine lines, sun damage, and minor facial scars, are most effective when used in combination with other acne treatments. They may cause temporary, severe redness, scaling and blistering, and long-term discoloration of the skin.

In addition to the negative side-effects caused by the currently available treatments, there is no treatment available that is personalized to patients to target specific bacteria causing acne on an individual level. Additionally, it will be useful for dermatologists to know which strains are dominant on the skin of a patient at the time of diagnosis in order to personalize acne treatments. Thus, there exists a need in the art for methods of personalized diagnoses and treatment of acne.

BRIEF SUMMARY OF THE INVENTION

The present invention is directed to methods of diagnosis and personalized treatment in patients afflicted with acne.

In one embodiment, the invention provides a method for determining whether an individual possesses acne comprising: obtaining a skin sample from an individual; isolating bacterial DNA from said sample; amplifying 16S ribosomal DNA in said sample; sequencing said amplified DNA products; and typing the individual's DNA based on one or more of the ten major ribotypes (RTs) of *P. acnes* strains, RT1-RT10 (SEQ ID NOs 1-10), wherein said typing occurs by determining whether said individual possesses one or more of RT1-RT10 and wherein said individual is diagnosed as having acne if said individual possesses RT4, RT5, RT7, RT8, RT9, or RT10. For example, said individual may be diagnosed as having acne if said individual possesses RT4 (SEQ ID NO:4), RT5 (SEQ ID NO:5), or RT8 (SEQ ID NO:8).

In another embodiment, the invention provides a method for diagnosing different types of acne comprising: obtaining a skin sample from a subject; isolating bacterial DNA from said sample; amplifying 16S ribosomal DNA in said sample; sequencing said amplified DNA products; and typing the subject's DNA based on one or more of the five major microbiome types of *P. acnes* strains, wherein said subject is diagnosed as having acne if said subject is typed to microbiome IV or V.

In yet another embodiment, the invention provides a method for rapidly diagnosing acne comprising: obtaining a skin sample from a subject; isolating bacterial DNA from said sample; using one or more primer sets to amplify said DNA; and analyzing said amplified DNA for the presence of a sequence having at least 95% homology with at least one of SEQ ID NOs 29-32 and 82-434, wherein said subject is diagnosed as having acne if the presence of a sequence having at least 95% homology with at least one of SEQ ID NOs 29-32 and 82-434 exists. For example, said amplified DNA may be analyzed for the presence of a sequence having at least 99% homology with at least one of SEQ ID NOs 29-32 and 82-434 and wherein said subject is diagnosed as having acne if the presence of a sequence having at least 99% homology with at least one of SEQ ID NOs 29-32 and 82-434 exists. As another example, said amplified DNA may be analyzed for the presence of at least one of SEQ ID NOs 29-32 and 82-434 and wherein said subject is diagnosed as having acne if the presence of at least one of SEQ ID NOs 29-32 and 82-434 exists.

In another embodiment, the invention provides a method for rapidly diagnosing acne comprising: obtaining a skin sample from a subject; isolating bacterial DNA from said sample; using one or more primer sets to amplify said DNA; using one or more probes to detect said amplified DNA; and analyzing said probe signals for the presence of Locus 1 (at least one sequence having at least 95% homology to at least one of SEQ ID NOs 29 and 82-97), Locus 2 (at least one sequence having at least 95% homology to at least one of SEQ ID NOs 30 and 98-186), Locus 3 (at least one sequence having at least 95% homology to at least one of SEQ ID NOs 31 and 187-423), and/or Locus 4 (at least one sequence having at least 95% homology to at least one of SEQ ID NOs 32 and 424-434), wherein said subject is diagnosed as having acne if one or more of Loci 1-4 are present. For example, the signals may be analyzed for the presence of Locus 1, Locus 2, Locus 3, and/or Locus 4 based upon at least 99% homology or 100% homology.

In the foregoing methods, a primer of said primer sets may be selected from the group consisting of SEQ ID NOs 11, 12, 17, and 18 (for Locus 1), SEQ ID NOs 13, 14, 20, and 21 (for Locus 2), SEQ ID NOs 15, 16, 23, and 24 (for Locus 3), and SEQ ID NOs 26 and 27 (for Locus 4). In the foregoing methods, said probes may be SEQ ID NO:19 (for Locus 1), SEQ ID NO:22 (for Locus 2), SEQ ID NO:25 (for Locus 3), and SEQ ID NO:28 (for Locus 4).

In yet another embodiment, the invention provides a vaccine for the prevention and/or treatment of acne caused by *P. acnes* comprising a heat inactivated *P. acnes* strain, an attenuated protein of said strain, or combination thereof, wherein said strain is an RT4 strain, an RT5 strain, an RT7 strain, an RT8 strain, an RT9 strain, or an RT10 strain.

In yet another embodiment, the invention provides a vaccine for the prevention and/or treatment of acne caused by *P. acnes* comprising a heat inactivated *P. acnes* strain, an attenuated protein of said strain, or combination thereof identified to be specific to a subject based on 16S rDNA sequence analysis of the strains of *P. acnes* affecting said subject.

With regard to the vaccines, said heat inactivated *P. acnes* strain, attenuated protein, or combination thereof may be specific for at least one of unique genomic loci, regions, or sequences identified for the strains of *P. acnes*. Said heat inactivated *P. acnes* strain, attenuated protein, or combination thereof may be specific for at least one of Locus 1 (SEQ ID NOs 29 and 82-97), Locus 2 (SEQ ID NOs 30 and 98-186), Locus 3 (31 and 187-423), and Locus 4 (32 and 424-434).

In yet another embodiment, the invention provides a method for the personalized treatment of acne comprising determining the strains of *P. acnes* affecting a subject and treating said subject with an active ingredient directed to at least one detected strain of *P. acnes*, wherein the active ingredient comprises a drug targeting specific strains of *P. acnes*, wherein the targeting drug comprises small molecules, antisense molecules, siRNA, biologics, antibodies, and combinations thereof targeting genomic elements specific for strains of *P. acnes* associated with acne.

In yet another embodiment, the invention provides a method for treating acne comprising: administering an effective amount of a probiotic that comprises at least one strain of *P. acnes* that is associated with healthy or normal skin based on its 16S rDNA. Said strain may be an RT6 strain. Said strain may have at least 95% homology to SEQ ID NO:51, SEQ ID NO:52, SEQ ID NO:53, or SEQ ID NO:54, such as at least 99% homology or 100% homology.

In yet another embodiment, the invention provides a method for treating acne comprising: administering an effective amount of a metabolite produced by a strain of *P. acnes* that is associated with healthy or normal skin, wherein said metabolite is selected from the group comprising bacterial culture supernatant, cell lysate, proteins, nucleic acids, lipids, and other bacterial molecules. Said strain may be an RT6 strain. Said strain may have at least 95% homology to SEQ ID NO:51, SEQ ID NO:52, SEQ ID NO:53, or SEQ ID NO:54, such as at least 99% homology or 100% homology.

In yet another embodiment, the invention provides a method for treating acne in a subject comprising: administering an effective amount of a drug specifically targeting RT4, RT5, RT7, RT8, RT9, or RT10, when said subject is determined to possess RT4, RT5, RT7, RT8, RT9, or RT10, respectively. The earlier-described methods may be performed prior to administration of said drug. Said drug may be a small molecule, antisense molecule, siRNA, biologic, antibody, or combination thereof.

In yet another embodiment, the invention provides a composition comprising at least one strain of *P. acnes* that is associated with healthy or normal skin. Said strain may be an RT6 strain. Said strain may have at least 95% homology to SEQ ID NO:51, SEQ ID NO:52, SEQ ID NO:53, or SEQ ID NO:54, such as at least 99% homology or 100% homology.

In yet another embodiment, the invention provides a method for diagnosing IB-3-based acne comprising: obtaining a skin sample from a subject; isolating bacterial DNA from said sample; using one or more primer sets to amplify said DNA; and analyzing said amplified DNA for the presence of a sequence having at least 95% homology with at least one of SEQ ID NOs 55-81, wherein said subject is diagnosed as having IB-3-based acne if the presence of a sequence having at least 95% homology with at least one of SEQ ID NOs 55-81 exists.

In yet another embodiment, the invention provides a method for the personalized treatment of acne comprising determining the strain(s) of acne affecting a subject and administering to said subject an effective amount of at least one phage specifically directed to said strain(s). For example, the subject may be treated with phage directed against an RT4 strain, an RT5 strain, an RT7 strain, and RT8 strain, an RT9 strain, and/or an RT10 strain.

In yet another embodiment, the invention provides a method for treating an individual suffering from acne of microbiome type I comprising administering to said individual an effective amount of a phage, wherein said phage is selected from the group consisting of: PHL113M01 (SEQ ID NO:36), PHL111M01 (SEQ ID NO:33), PHL082M00 (SEQ ID NO:47), PHL060L00 (SEQ ID NO:34), PHL067M10 (SEQ ID NO:42), PHL071N05 (SEQ ID NO:41), PHL112N00 (SEQ ID NO:35), PHL037M02 (SEQ ID NO:40), PHL085N00 (SEQ ID NO:46), PHL115M02 (SEQ ID NO:43), PHL085M01 (SEQ ID NO:44), PHL114L00 (SEQ ID NO:37), PHL010M04 (SEQ ID NO:38), and PHL066M04 (SEQ ID NO:39).

In yet another embodiment, the invention provides a method for treating an individual suffering from acne of microbiome type I with IB-3 strain comprising administering to said individual an effective amount of a phage, wherein said phage is selected from the group consisting of: PHL082M00 (SEQ ID NO:47) and PHL071N05 (SEQ ID NO:41).

In yet another embodiment, the invention provides a method for treating an individual suffering from acne of microbiome type II comprising administering to said individual an effective amount of a phage, wherein said phage is selected from the group consisting of: PHL113M01 (SEQ ID NO:36), PHL060L00 (SEQ ID NO:34), PHL112N00 (SEQ ID NO:35), and PHL085M01 (SEQ ID NO:44).

In yet another embodiment, the invention provides a method for treating an individual suffering from acne of microbiome type III or dominant RT8 comprising administering to said individual an effective amount of a phage, wherein said phage is selected from the group consisting of: PHL113M01 (SEQ ID NO:36), PHL111M01 (SEQ ID NO:33), PHL082M00 (SEQ ID NO:47), PHL060L00 (SEQ ID NO:34), PHL067M10 (SEQ ID NO:42), PHL071N05 (SEQ ID NO:41), PHL112N00 (SEQ ID NO:35), PHL037M02 (SEQ ID NO:45), PHL085N00 (SEQ ID NO:46), PHL115M02 (SEQ ID NO:43), PHL085M01 (SEQ ID NO:44), PHL114L00 (SEQ ID NO:37), PHL073M02 (SEQ ID NO:40), PHL010M04 (SEQ ID NO:38), and PHL066M04 (SEQ ID NO:39).

In yet another embodiment, the invention provides a method for treating an individual suffering from acne of microbiome type IV comprising administering to said individual an effective amount of a phage, wherein said phage is selected from the group consisting of: PHL113M01 (SEQ ID NO:36), PHL111M01 (SEQ ID NO:33), PHL082M00 (SEQ ID NO:47), PHL060L00 (SEQ ID NO:34), PHL067M10 (SEQ ID NO:42), PHL071N05 (SEQ ID NO:41), PHL112N00 (SEQ ID NO:35), PHL037M02 (SEQ ID NO:45), PHL085N00 (SEQ ID NO:46), PHL115M02 (SEQ ID NO:43), PHL085M01 (SEQ ID NO:44), PHL114L00 (SEQ ID NO:37), PHL073M02 (SEQ ID NO:40), PHL010M04 (SEQ ID NO:38), and PHL066M04 (SEQ ID NO:39).

In yet another embodiment, the invention provides a method for treating an individual suffering from acne of microbiome type V comprising administering to said individual an effective amount of a phage, wherein said phage is selected from the group consisting of: PHL113M01 (SEQ ID NO:36), PHL111M01 (SEQ ID NO:33), PHL082M00 (SEQ ID NO:47), PHL060L00 (SEQ ID NO:34), PHL067M10 (SEQ ID NO:42), PHL071N05 (SEQ ID NO:41), PHL112N00 (SEQ ID NO:35), PHL037M02 (SEQ ID NO:45), PHL085N00 (SEQ ID NO:46), PHL115M02 (SEQ ID NO:43), PHL085M01 (SEQ ID NO:44), PHL114L00 (SEQ ID NO:37), PHL073M02 (SEQ ID NO:40), PHL010M04 (SEQ ID NO:38), and PHL066M04 (SEQ ID NO:39).

In yet another embodiment, the invention provides a method for treating a *Propionibacterium humerusii*-associated malady comprising administering to said individual an effective amount of a phage, wherein said phage is selected from the group consisting of: PHL113M01 (SEQ ID NO:36), PHL111M01 (SEQ ID NO:33), PHL082M00 (SEQ ID NO:47), PHL067M10 (SEQ ID NO:42), PHL071N05 (SEQ ID NO:41), PHL085N00 (SEQ ID NO:46), PHL085M01 (SEQ ID NO:44), PHL114L00 (SEQ ID NO:37), PHL073M02 (SEQ ID NO:40), and PHL010M04 (SEQ ID NO:38).

In yet another embodiment, the invention provides a kit for diagnosing acne in a subject, wherein said kit comprises: at least one primer selected from the group comprising SEQ ID NOs 11-18, 20, 21, 23, 24, 26, and 27; and instructions for use.

In yet another embodiment, the invention provides a kit for diagnosing acne in a subject, wherein said kit comprises: at least one primer selected from the group comprising SEQ ID NOs 11-18, 20, 21, 23, 24, 26, and 27; at least one probe selected from the group comprising SEQ ID NOs 19, 22, 25, and 28; and instructions for use.

BRIEF DESCRIPTION OF THE FIGURES

FIG. 37 reflects sequence conservation in protospacers and PAMs. The protospacers that match exactly to the CRISPR spacers encoded in strain HL042PA3 and their associated PAM sequences are shown. Sequence conservation among the protospacer motifs from the phages that HL042PA3 is resistant to is shown in (A) and susceptible to is shown in (B).

DETAILED DESCRIPTION

Figure 1:
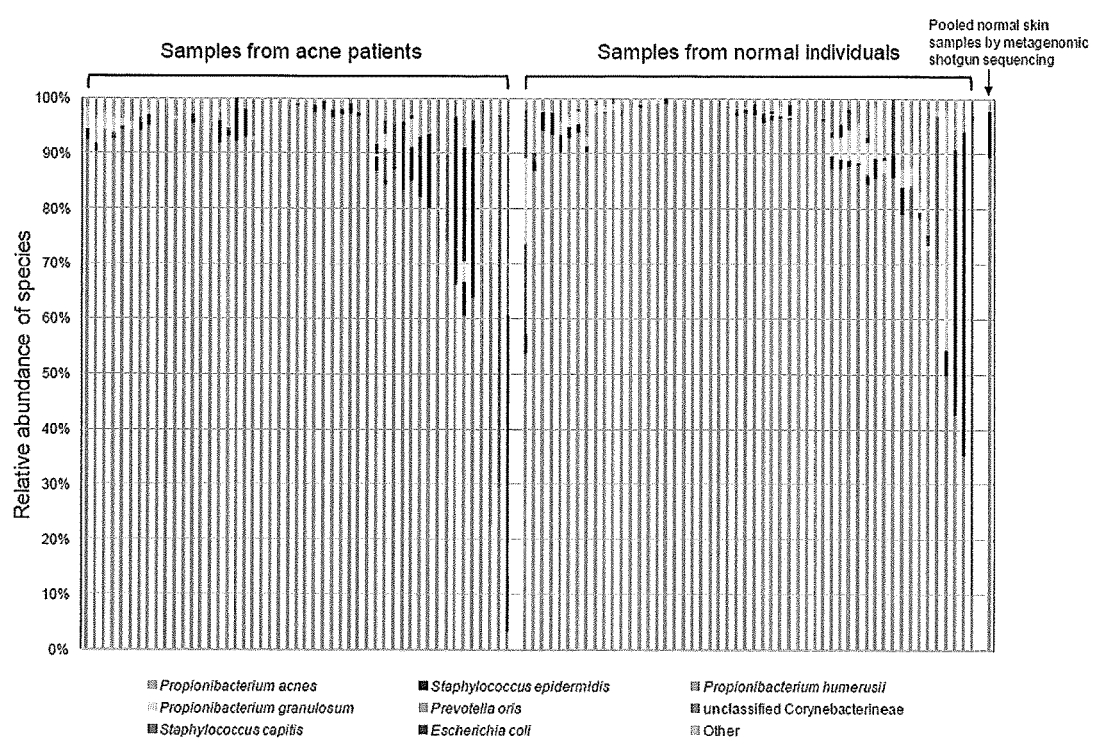
FIG. 1 shows that *P. acnes* dominates the microbiota of pilosebaceous units, accounting for 87% of the clones. *P. acnes* was dominant in pilosebaceous units in both acne patients and individuals with normal skin. By 16S rDNA sequencing, *P. acnes* sequences accounted for 87% of all the clones. Species with a relative abundance greater than 0.35% are listed in order of relative abundance. Species distribution from a metagenomic shotgun sequencing of pooled samples from normal individuals confirmed the high abundance of *P. acnes* in pilosebaceous units, as shown on the far right column.

In one embodiment, the invention provides a method for determining whether an individual possesses acne comprising: obtaining a skin sample from an individual; isolating bacterial DNA from said sample; amplifying 16S ribosomal DNA in said sample; sequencing said amplified DNA products; and typing the individual's DNA based on one or more of the ten major ribotypes (RTs) of *P. acnes* strains, RT1-RT10 (SEQ ID NOs 1-10), wherein said typing occurs by determining whether said individual possesses one or more of RT1-RT10 and wherein said individual is diagnosed as having acne if said individual possesses RT4, RT5, RT7, RT8, RT9, or RT10. For example, said individual may be diagnosed as having acne if said individual possesses RT4 (SEQ ID NO:4), RT5 (SEQ ID NO:5), or RT8 (SEQ ID NO:8).

In another embodiment, the invention provides a method for diagnosing different types of acne comprising: obtaining a skin sample from a subject; isolating bacterial DNA from said sample; amplifying 16S ribosomal DNA in said sample; sequencing said amplified DNA products; and typing the subject's DNA based on one or more of the five major microbiome types of *P. acnes* strains, wherein said subject is diagnosed as having acne if said subject is typed to microbiome IV or V.

In yet another embodiment, the invention provides a method for rapidly diagnosing acne comprising: obtaining a skin sample from a subject; isolating bacterial DNA from said sample; using one or more primer sets to amplify said DNA; and analyzing said amplified DNA for the presence of a sequence having at least 95% homology with at least one of SEQ ID NOs 29-32 and 82-434, wherein said subject is diagnosed as having acne if the presence of a sequence having at least 95% homology with at least one of SEQ ID NOs 29-32 and 82-434 exists. For example, said amplified DNA may be analyzed for the presence of a sequence having at least 99% homology with at least one of SEQ ID NOs 29-32 and 82-434 and wherein said subject is diagnosed as having acne if the presence of a sequence having at least 99% homology with at least one of SEQ ID NOs 29-32 and 82-434 exists. As another example, said amplified DNA may be analyzed for the presence of at least one of SEQ ID NOs 29-32 and 82-434 and wherein said subject is diagnosed as having acne if the presence of at least one of SEQ ID NOs 29-32 and 82-434 exists.

In another embodiment, the invention provides a method for rapidly diagnosing acne comprising: obtaining a skin sample from a subject; isolating bacterial DNA from said sample; using one or more primer sets to amplify said DNA; using one or more probes to detect said amplified DNA; and analyzing said probe signals for the presence of Locus 1 (at least one sequence having at least 95% homology to at least one of SEQ ID NOs 29 and 82-97), Locus 2 (at least one sequence having at least 95% homology to at least one of SEQ ID NOs 30 and 98-186), Locus 3 (at least one sequence having at least 95% homology to at least one of SEQ ID NOs 31 and 187-423), and/or Locus 4 (at least one sequence having at least 95% homology to at least one of SEQ ID NOs 32 and 424-434), wherein said subject is diagnosed as having acne if one or more of Loci 1-4 are present. For example, the signals may be analyzed for the presence of Locus 1, Locus 2, Locus 3, and/or Locus 4 based upon at least 99% homology or 100% homology.

In the foregoing methods, a primer of said primer sets may be selected from the group consisting of SEQ ID NOs 11, 12, 17, and 18 (for Locus 1), SEQ ID NOs 13, 14, 20, and 21 (for Locus 2), SEQ ID NOs 15, 16, 23, and 24 (for Locus 3), and SEQ ID NOs 26 and 27 (for Locus 4). In the foregoing methods, said probes may be SEQ ID NO:19 (for Locus 1), SEQ ID NO:22 (for Locus 2), SEQ ID NO:25 (for Locus 3), and SEQ ID NO:28 (for Locus 4).

In yet another embodiment, the invention provides a vaccine for the prevention and/or treatment of acne caused by *P. acnes* comprising a heat inactivated *P. acnes* strain, an attenuated protein of said strain, or combination thereof, wherein said strain is an RT4 strain, an RT5 strain, an RT7 strain, an RT8 strain, an RT9 strain, or an RT10 strain.

In yet another embodiment, the invention provides a vaccine for the prevention and/or treatment of acne caused by *P. acnes* comprising a heat inactivated *P. acnes* strain, an attenuated protein of said strain, or combination thereof identified to be specific to a subject based on 16S rDNA sequence analysis of the strains of *P. acnes* affecting said subject.

With regard to the vaccines, said heat inactivated *P. acnes* strain, attenuated protein, or combination thereof may be specific for at least one of unique genomic loci, regions, or sequences identified for the strains of *P. acnes*. Said heat inactivated *P. acnes* strain, attenuated protein, or combination thereof may be specific for at least one of Locus 1 (SEQ ID NOs 29 and 82-97), Locus 2 (SEQ ID NOs 30 and 98-186), Locus 3 (31 and 187-423), and Locus 4 (32 and 424-434).

In yet another embodiment, the invention provides a method for the personalized treatment of acne comprising determining the strains of *P. acnes* affecting a subject and treating said subject with an active ingredient directed to at least one detected strain of *P. acnes*, wherein the active ingredient comprises a drug targeting specific strains of *P. acnes*, wherein the targeting drug comprises small molecules, antisense molecules, siRNA, biologics, antibodies, and combinations thereof targeting genomic elements specific for strains of *P. acnes* associated with acne.

In yet another embodiment, the invention provides a method for treating acne comprising: administering an effective amount of a probiotic that comprises at least one strain of *P. acnes* that is associated with healthy or normal skin based on its 16S rDNA. Said strain may be an RT6 strain. Said strain may have at least 95% homology to SEQ ID NO:51, SEQ ID NO:52, SEQ ID NO:53, or SEQ ID NO:54, such as at least 99% homology or 100% homology.

In yet another embodiment, the invention provides a method for treating acne comprising: administering an effective amount of a metabolite produced by a strain of *P. acnes* that is associated with healthy or normal skin, wherein said metabolite is selected from the group comprising bacterial culture supernatant, cell lysate, proteins, nucleic acids, lipids, and other bacterial molecules. Said strain may be an RT6 strain. Said strain may have at least 95% homology to SEQ ID NO:51, SEQ ID NO:52, SEQ ID NO:53, or SEQ ID NO:54, such as at least 99% homology or 100% homology.

In yet another embodiment, the invention provides a method for treating acne in a subject comprising: administering an effective amount of a drug specifically targeting RT4, RT5, RT7, RT8, RT9, or RT10, when said subject is determined to possess RT4, RT5, RT7, RT8, RT9, or RT10, respectively. The earlier-described methods may be performed prior to administration of said drug. Said drug may be a small molecule, antisense molecule, siRNA, biologic, antibody, or combination thereof.

In yet another embodiment, the invention provides a composition comprising at least one strain of *P. acnes* that is associated with healthy or normal skin. Said strain may be an RT6 strain. Said strain may have at least 95% homology to SEQ ID NO:51, SEQ ID NO:52, SEQ ID NO:53, or SEQ ID NO:54, such as at least 99% homology or 100% homology.

In yet another embodiment, the invention provides a method for diagnosing IB-3-based acne comprising: obtaining a skin sample from a subject; isolating bacterial DNA from said sample; using one or more primer sets to amplify said DNA; and analyzing said amplified DNA for the presence of a sequence having at least 95% homology with at least one of SEQ ID NOs 55-81, wherein said subject is diagnosed as having IB-3-based acne if the presence of a sequence having at least 95% homology with at least one of SEQ ID NOs 55-81 exists.

In yet another embodiment, the invention provides a method for the personalized treatment of acne comprising determining the strain(s) of acne affecting a subject and administering to said subject an effective amount of at least one phage specifically directed to said strain(s). For example, the subject may be treated with phage directed against an RT4 strain, an RT5 strain, an RT7 strain, and RT8 strain, an RT9 strain, and/or an RT10 strain.

In yet another embodiment, the invention provides a method for treating an individual suffering from acne of microbiome type I comprising administering to said individual an effective amount of a phage, wherein said phage is selected from the group consisting of: PHL113M01 (SEQ ID NO:36), PHL111M01 (SEQ ID NO:33), PHL082M00 (SEQ ID NO:47), PHL060L00 (SEQ ID NO:34), PHL067M10 (SEQ ID NO:42), PHL071N05 (SEQ ID NO:41), PHL112N00 (SEQ ID NO:35), PHL037M02 (SEQ ID NO:40), PHL085N00 (SEQ ID NO:46), PHL115M02 (SEQ ID NO:43), PHL085M01 (SEQ ID NO:44), PHL114L00 (SEQ ID NO:37), PHL010M04 (SEQ ID NO:38), and PHL066M04 (SEQ ID NO:39).

In yet another embodiment, the invention provides a method for treating an individual suffering from acne of microbiome type I with IB-3 strain comprising administering to said individual an effective amount of a phage, wherein said phage is selected from the group consisting of: PHL082M00 (SEQ ID NO:47) and PHL071N05 (SEQ ID NO:41).

In yet another embodiment, the invention provides a method for treating an individual suffering from acne of microbiome type II comprising administering to said individual an effective amount of a phage, wherein said phage is selected from the group consisting of: PHL113M01 (SEQ ID NO:36), PHL060L00 (SEQ ID NO:34), PHL112N00 (SEQ ID NO:35), and PHL085M01 (SEQ ID NO:44).

In yet another embodiment, the invention provides a method for treating an individual suffering from acne of microbiome type III or dominant RT8 comprising administering to said individual an effective amount of a phage, wherein said phage is selected from the group consisting of: PHL113M01 (SEQ ID NO:36), PHL111M01 (SEQ ID NO:33), PHL082M00 (SEQ ID NO:47), PHL060L00 (SEQ ID NO:34), PHL067M10 (SEQ ID NO:42), PHL071N05 (SEQ ID NO:41), PHL112N00 (SEQ ID NO:35), PHL037M02 (SEQ ID NO:45), PHL085N00 (SEQ ID NO:46), PHL115M02 (SEQ ID NO:43), PHL085M01 (SEQ ID NO:44), PHL114L00 (SEQ ID NO:37), PHL073M02 (SEQ ID NO:40), PHL010M04 (SEQ ID NO:38), and PHL066M04 (SEQ ID NO:39).

In yet another embodiment, the invention provides a method for treating an individual suffering from acne of microbiome type IV comprising administering to said individual an effective amount of a phage, wherein said phage is selected from the group consisting of: PHL113M01 (SEQ ID NO:36), PHL111M01 (SEQ ID NO:33), PHL082M00 (SEQ ID NO:47), PHL060L00 (SEQ ID NO:34), PHL067M10 (SEQ ID NO:42), PHL071N05 (SEQ ID NO:41), PHL112N00 (SEQ ID NO:35), PHL037M02 (SEQ ID NO:45), PHL085N00 (SEQ ID NO:46), PHL115M02 (SEQ ID NO:43), PHL085M01 (SEQ ID NO:44), PHL114L00 (SEQ ID NO:37), PHL073M02 (SEQ ID NO:40), PHL010M04 (SEQ ID NO:38), and PHL066M04 (SEQ ID NO:39).

In yet another embodiment, the invention provides a method for treating an individual suffering from acne of microbiome type V comprising administering to said individual an effective amount of a phage, wherein said phage is selected from the group consisting of: PHL113M01 (SEQ ID NO:36), PHL111M01 (SEQ ID NO:33), PHL082M00 (SEQ ID NO:47), PHL060L00 (SEQ ID NO:34), PHL067M10 (SEQ ID NO:42), PHL071N05 (SEQ ID NO:41), PHL112N00 (SEQ ID NO:35), PHL037M02 (SEQ ID NO:45), PHL085N00 (SEQ ID NO:46), PHL115M02 (SEQ ID NO:43), PHL085M01 (SEQ ID NO:44), PHL114L00 (SEQ ID NO:37), PHL073M02 (SEQ ID NO:40), PHL010M04 (SEQ ID NO:38), and PHL066M04 (SEQ ID NO:39).

In yet another embodiment, the invention provides a method for treating a *Propionibacterium humerusii*-associated malady comprising administering to said individual an effective amount of a phage, wherein said phage is selected from the group consisting of: PHL113M01 (SEQ ID NO:36), PHL111M01 (SEQ ID NO:33), PHL082M00 (SEQ ID NO:47), PHL067M10 (SEQ ID NO:42), PHL071N05 (SEQ ID NO:41), PHL085N00 (SEQ ID NO:46), PHL085M01 (SEQ ID NO:44), PHL114L00 (SEQ ID NO:37), PHL073M02 (SEQ ID NO:40), and PHL010M04 (SEQ ID NO:38).

In yet another embodiment, the invention provides a kit for diagnosing acne in a subject, wherein said kit comprises: at least one primer selected from the group comprising SEQ ID NOs 11-18, 20, 21, 23, 24, 26, and 27; and instructions for use.

In yet another embodiment, the invention provides a kit for diagnosing acne in a subject, wherein said kit comprises: at least one primer selected from the group comprising SEQ ID NOs 11-18, 20, 21, 23, 24, 26, and 27; at least one probe selected from the group comprising SEQ ID NOs 19, 22, 25, and 28; and instructions for use.

Nucleotide, polynucleotide, or nucleic acid sequence will be understood to mean both a double-stranded or single-stranded DNA in the monomeric and dimeric forms and the transcription products of said DNAs.

Homologous nucleotide sequence means a nucleotide sequence having at least a percentage identity with the bases of a nucleotide sequence according to the invention of at least 80%, preferably 90%, 95%, 96%, 97%, 98%, 99% or 100%. This percentage is statistical and the differences between two nucleotide sequences may be determined at random or over the whole of their length.

The invention comprises the polypeptides encoded by a nucleotide sequence according to the invention, including a polypeptide whose sequence is represented by a fragment. Herein, the terms polypeptide, peptide, and protein are interchangeable.

Polypeptides allow monoclonal or polyclonal antibodies to be prepared which are characterized in that they specifically recognize the polypeptides. The invention relates to mono- or polyclonal antibodies or their fragments, or chimeric antibodies, characterized in that they are capable of specifically recognizing a polypeptide. Polypeptides used in vaccine compositions according to the invention may be selected by techniques known to the person skilled in the art such as, for example, depending on the capacity of said polypeptides to stimulate the T cells, which is translated, for example, by their proliferation or the secretion of interleukins, and which leads to the production of antibodies directed against said polypeptides. Vaccine combinations will preferably be combined with a pharmaceutically acceptable vehicle and, if need be, with one or more adjuvants of the appropriate immunity. Pharmaceutically acceptable vehicle means a compound or a combination of compounds that does not provoke secondary reactions and which allows, for example, the facilitation of the administration of the active compound, an increase in its duration of life and/or its efficacy in the body, an increase in its solubility in solution, or an improvement in its conservation.

Applicants identified ten major lineages of *Propionibacterium acnes* and five major microbiome types in the human pilosebaceous unit ("pore"), where acne arises. Some of the *P. acnes* lineages and microbiome types are highly enriched in acne patients and some are associated with healthy skin. The unique genomic components of each major lineage, including a linear plasmid that is unique to acne-associated lineages, have been identified. This information is used to, for example: (1) for a method/kit to isolate bacterial DNA/RNA from pilosebaceous units for downstream analysis: (2)

rapidly and accurately detect/diagnose/identify the microbiome type of the affected subject and the major strains of *P. acnes* present in the pores of the affected subject; (3) develop vaccines against acne-associated *P. acnes* strains; (4) develop probiotics using the strains associated with healthy skin in topical creams, solutions, and the like; (5) develop drugs, including small molecules, biologics, and antibodies targeting the genetic elements and biological pathways unique to the *P. acnes* strains associated with acne, and (6) to develop bacteriophage-based strain specific therapy to treat acne.

Once the microbiome type of a subject affected with acne is diagnosed, several approaches described below may be used formulate an effective treatment plan. For example, if the subjects have microbiome types IV or V, or are dominated by *P. acnes* RT10 strains, it is less likely that antibiotic treatment will succeed because these strains are antibiotic resistant. However, other method treatments remain available, such as retinoids.

According to one embodiment of the invention, in a case where the subject has the virulent ribotypes, including RT4, RT5, and RT8, target specific drugs including small molecules, biologics, and antibodies may be more effective treatments. In a preferred embodiment of the invention, such a patient may be treated with antibodies targeting the genetic elements and biological pathways that are unique to *P. acnes* strains associated with acne.

According to another embodiment of the invention, in a case where the dominant *P. acnes* strains affecting the subject do not harbor a set of CRISPR/Cas, the additional treatment of phage therapy may be more effective.

The present invention also pertains to alternative treatment strategies for acne treatment to balance the relative abundance of *P. acnes* strains by promoting the growth of health-associated strains.

The present invention pertains to methods and kits to isolate bacterial DNA/RNA from pores of affected subjects for downstream genetic analysis. More specifically, the present invention pertains to protocols for the extraction of bacterial genomic DNA and RNA from microcomedone spamples. In one particular embodiment of the invention, Biore® Deep Cleansing Pore Strips may be used to sampl the bacteria from a subject. Genomic DNA may be extracted according to methods known in the art. For example, the QIAamp DNA Micro Kit (Qiagen) is a commercially available kit that may be used to extract genomic DNA from the supernatant obtained by lysing cells/microcomedones using a beadbeater.

The present invention also pertains to fast and accurate methods and kits for the detection and/or diagnosis of microbiome types in affected subjects. The microbiome typing/microbiome-specific treatment is based on ten major lineages of *P. acnes* strains and five major microbiome types in the human pilosebaceous unit found through a comprehensive metagenomic analysis using full length 16S rDNA sequencing.

Indeed, samples were PCR-amplified using 16S rDNA specific primers with the following sequences: 27f-MP 5'AGRGTTTGATCMTGGCTCAG-3' and 1492r-MP 5'-TACGGYTACCTTGTTAYGACTT-3'. Optionally, following gel purification, the 1.4 Kb product is excised and further purified using, for example, a Quigen QIAquick Gel Extraction Kit. The purified product is cloned into OneShot *E coli*. cells using, for example, a TOPO TA cloning kit from Invitrogen. Sequencing is done with a universal forward, universal reverse, and for a subset, internal 16S rDNA primer 907R with sequences of TGTAAAACGACGGC-CAGT (forward), CAGGAAACAGCTATGACC (reverse), and CCGTCAATTCCTTTRAGTTT (907R). Sequence reactions were loaded on ABI 3730 machines from ABI on 50 cm arrays with a long read run module.

Each lineage of *P. acnes* has unique genomic loci, regions, and sequences. Accordingly, specific primers may be generated to target the lineage-specific genomic regions to detect the presence or absence of each lineage, as well as the relative amount of each lineage using methods known in the art, such as PCR/qPCR. This occurs within several hours of obtaining the samples. Prior to Applicants' invention, this required much more time—often weeks using culture-based methods. According to one embodiment of the invention, affected subjects are grouped for microbiome specific treatments based on these diagnoses.

According to the methods of the present invention, unique genomic loci 1, 2, and 3 for strains of ribotypes 4 and 5 have been shown to be associated with acne. Using specific primers targeting for loci 1, 2 and 3, lineages that contain these loci can be distinguished from lineages that lack these loci. In addition, using PCR/qPCR techniques, the relative abundance of each strain may also be detected. Analysis of a mock community has shown that isolates with loci 1, 2 and 3 in an abundance of 7.5% or higher in the microbiome may be detected using these techniques. Given the sensitivity of qPCR, lower abundance levels to a few DNA copies may also be detectable.

It has previously been reported that heat inactivation of *P. acnes* may be an effective means of developing *P. acnes*-based vaccines. See T. Nakatsuji et al., 128(10) J. Invest. Dermatol. 2451-2457 (October 2008). In one aspect of the present invention, vaccines are developed against acne-associated *P. acnes* strains. In another aspect of the present invention, personalized vaccines are developed against acne-associated *P. acnes* strains. In yet another aspect of the present invention, vaccines are developed against acne-associated *P. acnes* strains using inactive *P. acnes* strains or heat attenuated proteins. Strains suitable for use as vaccines may be identified based on 16S rDNA sequencing, indentifying lineages of *P. acnes* strains associated with acne, and the unique genomic loci, regions, and sequences for each lineage to specifically target strains of *P. acnes* associated with acne and not those strains associated with healthy skin.

According to methods described above, it has been discovered that *P. acnes* strains with ribotypes 4, 5, 7, 8, 9, and 10 are highly associated with acne. In one embodiment of the present invention, a vaccine is raised against these individual strains separately or in combination. Similarly, the genes in loci 1, 2, and 3 may be targets for vaccination because these loci are unique to ribotypes 4 and 5, and are not found in commensal strains. Locus 4, which is unique to ribotype 8 may also serve as a potential target for vaccine therapy. The list of genes encoded in loci 1, 2, 3, and 4 are shown in Table 2.

The present invention also pertains to probiotics developed using *P. acnes* strains associated with healthy skin in medicines, compositions, topical creams, solutions, or other cosmetic products. Probiotics have, in the past, been used in topical creams. PROBIOTIC LAB™ announced that mixture of 14 specific strains of bacteria was used for treatment of cystic acne (www.probiotic-lab.com/aboutusprobiotic-lab.html). Probiotic skin care/DERMBIOTIX has a product line—Probiotic Collagen Complex (PC3), which is claimed to have targeted anti-aging benefits to the skin. However, this is not targeted to acne treatment. Probiotic Collagen Complex (PC3) infuses the skin with the positive bacteria required to effectively combat and eradicate excess negative bacteria caused by external factors (www.dermbiotix.com). However, prior to the present invention there existed no skin probiotic product reported for acne treatment using *P. acnes* strains associated with healthy/normal skin. In one aspect of the present invention, skin probiotics are developed for acne treatment using *P. acnes* strains associated with healthy/normal skin. In another aspect of the present invention, skin probiotics are developed for acne treatment using *P. acnes* strains associated with healthy/normal skin based on the 16S rDNA sequencing.

In one particular embodiment of the present invention the RT6 lineage of *P. acnes* and associated with healthy skin is used as a topical product. In yet another embodiment of the present invention the RT6 lineage of *P. acnes* is used by inoculating this isolate on the human skin in order to compete off the acne associated strains. In another embodiment, molecules, including proteins, nucleic acids, lipids, and other metabolites, supernatant of cultures, and/or cell lysate of these strains may be used at probiotics.

The present invention also pertains to drugs targeting acne associated *P. acnes* strains. This is based upon multiple genome comparison of *P. acnes* in combination with 16S rDNA metagenomic analysis, thereby identifying certain strains and genomic variations associated with acne. Drugs intended to target acne associated *P. acnes* include custom designed small molecules, antisense molecules, siRNA molecules, biologics, and antibodies targeting genomic elements specific for strains which are associated with acne. Antisense RNA, antibodies, or small molecules can be designed targeting loci 1, 2, 3, and 4. Strains with ribotypes 4, 5, and 10 are antibiotic resistant. Thus, there is a need in the art for new antibiotics targeting ribotypes 4, 5, and 10.

The present invention also pertains to personalized phage therapy for subjects affected with acne comprising phages specific to certain strains of *P. acnes*. Certain companies provide phage therapy for acne patients, such as the Phage Therapy Center™, www.phagetherapycenter.com/pii/PatientServlet? command=static_home). However, such companies provide no information on the bacterial host specificity of the phages used for the therapy. *P. acnes* is commensal and some strains play a protective role for hosts. In one embodiment of the invention, personalized phage therapies include a selections of phages targeting *P. acnes* strains that have been shown to lack a protective role for subjects affected by acne. In yet another embodiment of the invention, personalized phage therapy may be developed according to their bacterial host specificity of the phages to target specific strains of *P. acnes*, leaving health associated strains intact. In addition, it is possible to identify the structure of *P. acnes* lineages of the affected subjects and use that structure to predict resistance to phage infection or plasmid conjugation to better target specific phage therapies. For example, *P. acnes* lineages RT2 and RT6 have a CRISPR/Cas structure, indicating they have resistance against certain phage infection and plasmid conjugation. Table 5 shows the sensitivity and resistance of specific *P. acnes* strains to specific *P. acnes* phages.

The invention is described in more detail in the following illustrative examples. Although the examples may represent only selected embodiments of the invention, the following examples are illustrative only and in no way limiting.

EXAMPLES

Example 1—Analysis of *Propionibacterium Acnes* Strain Populations in the Human Skin Microbiome Associated with Acne The human skin microbiome plays important roles in skin health and disease. However, prior to Applicants' invention the bacterial population structure and diversity at the strain level was poorly understood. The inventors compared the skin microbiome at the strain level and genome level of *Propionibacterium acnes*, a dominant skin commensal, between 49 acne patients and 52 healthy individuals by sampling the pilosebaceous units on their noses. Metagenomic analysis demonstrated that while the relative abundances of *P. acnes* were similar, the strain population structures were significantly different in the two cohorts. Certain strains were highly associated with acne and other strains were enriched in healthy skin. By sequencing 66 novel *P. acnes* strains and comparing 71 *P. acnes* genomes, the inventors identified potential genetic determinants of various *P. acnes* strains in association with acne or health. The analysis indicates that acquired DNA sequences and bacterial immune elements may play roles in determining virulence properties of *P. acnes* strains and some may be targets for therapeutic interventions. This study demonstrates a previously-unreported paradigm of commensal strain populations that explains the pathogenesis of human diseases. It underscores the importance of strain level analysis of the human microbiome to define the role of commensals in health and disease.

Background

The diversity of the human microbiota at the strain level and its association with human health and disease are largely unknown. However, many studies had shown that microbe-related human diseases are often caused by certain strains of a species, rather than the entire species being pathogenic. Examples include methicillin-resistant *Staphylococcus aureus* (MRSA) (Chambers and Deleo, 2009; Chen et al., 2010; Hansra and Shinkai) and *Escherichia coli* O157 (Chase-Topping et al., 2008; Tarr et al., 2005). Acne vulgaris (commonly called acne) is one of the most common skin diseases with a prevalence of up to 85% of teenagers and 11% of adults (White, 1998). Although the etiology and pathogenesis of acne are still unclear, microbial involvement is considered one of the main mechanisms contributing to the development of acne (Bojar and Holland, 2004; Cunliffe, 2002). In particular, *Propionibacterium acnes* has been hypothesized to be an important pathogenic factor (Webster, 1995). Antibiotic therapy targeting *P. acnes* has been a mainstay treatment for more than 30 years (Leyden, 2001). However, despite decades of study, it remained unclear as to how *P. acnes* contributes to acne pathogenesis while being a major commensal of the normal skin flora (Bek-Thomsen et al., 2008; Cogen et al., 2008; Costello et al., 2009; Dominguez-Bello et al., 2010; Fierer et al., 2008; Gao et al., 2007; Grice et al., 2009). Whether *P. acnes* protects the human skin as a commensal bacterium or functions as a pathogenic factor in acne, or both, remained to be elucidated.

Thus, Applicants compared the skin microbiome at the strain level and genome level in 49 acne patients and 52 normal individuals using a combination of metagenomics and genome sequencing. First, for each sample, 16S ribosomal DNA (rDNA) was amplified, approximately 400 clones were sequenced, and an average of 311 nearly full length 16S rDNA sequences were analyzed. The population structure of *P. acnes* strains was determined in each sample. Second, each *P. acnes* strain was assigned an "acne index" by calculating its prevalence in acne patients based on the 16S rDNA metagenomic data. The *P. acnes* strains associated with the acne patient group were identified, as well as the strains enriched in the individuals with normal skin. This metagenomic approach is fundamentally different than prior approaches in determining disease associations; it is more powerful and less biased than traditional methods by bypassing the biases and selection in strain isolation and culturing. Lastly, 66 novel *P. acnes* strains were sequenced and 71 *P. acnes* genomes compared covering the major lineages of *P. acnes* found in the skin microbiota. By combining a metagenomic study of the skin microbiome and genome sequencing of this major skin commensal, Applicants' study provided insight into bacterial genetic determinants in acne pathogenesis and emphasizes the importance of strain level analysis of the human microbiome to understand the role of commensals in health and disease.

Results

*P. acnes* Dominates the Pilosebaceous Unit

Applicants characterized the microbiome in pilosebaceous units ("pores") on the nose collected from 49 acne patients and 52 individuals with normal skin. Nearly full length 16S rDNA sequences were obtained using Sanger method, which permitted analyzing the *P. acnes* at the strain level. After quality filtering, the final dataset contained 31,461 16S rDNA sequences ranging from position 29 to position 1483. 27,358 of the sequences matched to *P. acnes* with greater than 99% identity. The data demonstrated that *P. acnes* dominates the microbiota of pilosebaceous units, accounting for 87% of the clones (FIG. 1). Other commonly found species in pilosebaceous units included *Staphylococcus epidermidis*, *Propionibacterium humerusii*, and *Propionibacterium granulosum*, each representing 1%-2.3% of the total clones. A total of 536 species level operational taxonomic units (SLOTUs) belonging to 42 genera and six phyla were identified in the samples (Table 51).

TABLE S1

Six phyla and 42 genera found in pilosebaceous units.

| Phylum | Genus | Phylum | Genus |
|---|---|---|---|
| Actino-bacteria | *Actinobaculum* | Bacteroidetes | *Chryseobacterium* |
| | *Corynebacterium* | | *Niastella* |
| | *Gordonia* | | *Parabacteroides* |
| | *Kocuria* | | *Prevotella* |
| | *Microbacterium* | Proteobacteria | *Caulobacteraceae* |
| | *Propionibacterium* | | *Citrobacter* |
| Firmicutes | *Anaerococcus* | | *Cupriavidus* |
| | *Anoxybacillus* | | *Delftia* |
| | *Bacillus* | | *Diaphorobacter* |
| | *Enterococcus* | | *Haemophilus* |
| | *Erysipelothrix* | | *Klebsiella* |
| | *Finegoldia* | | *Massilia* |
| | *Gemella* | | *Neisseriaceae* |
| | *Lactobacillus* | | *Novosphingobium* |
| | *Paenibacillus* | | *Pelomonas* |
| | *Peptoniphilus* | | *Phyllobacterium* |
| | *Peptostreptococcaceae* | | *Ralstonia* |

TABLE S1-continued

Six phyla and 42 genera found in pilosebaceous units.

| Phylum | Genus | Phylum | Genus |
|---|---|---|---|
| | *Ruminococcaceae* | | *Shigella* |
| | *Staphylococcus* | | *Sphingomonas* |
| | *Streptococcus* | | *Stenotrophomonas* |
| Fuso-bacteria | *Fusobacterium* | Cyanobacteria | *Streptophyta* |

To bypass the potential biases due to PCR amplification and due to uneven numbers of 16S rDNA gene copies among different species, a metagenomic shotgun sequencing of the total DNA pooled from the pilosebaceous unit samples of 22 additional normal individuals was performed. Microbial species were identified by mapping metagenomic sequences to reference genomes. The results confirmed that *P. acnes* was the most abundant species (89%) (FIG. 1). This is consistent with the results obtained from 16S rDNA sequencing (87%).

For the 16S rRNA sequence, positions 27 to 1492 were PCR amplified. Yet, when analyzing the sequence only positions 29-1483 are studied. The numbering of positions is based on the *E. coli* system of nomenclature. Thus, the sequences between 29-1483 are important for determining the ribotype (there are many ribotypes, not just 10). As for the top 10 ribotypes, sequences between positions 529-1336 of the 16A rRNA are sufficient.

Different *P. acnes* Strain Populations in Acne

Figure 2:
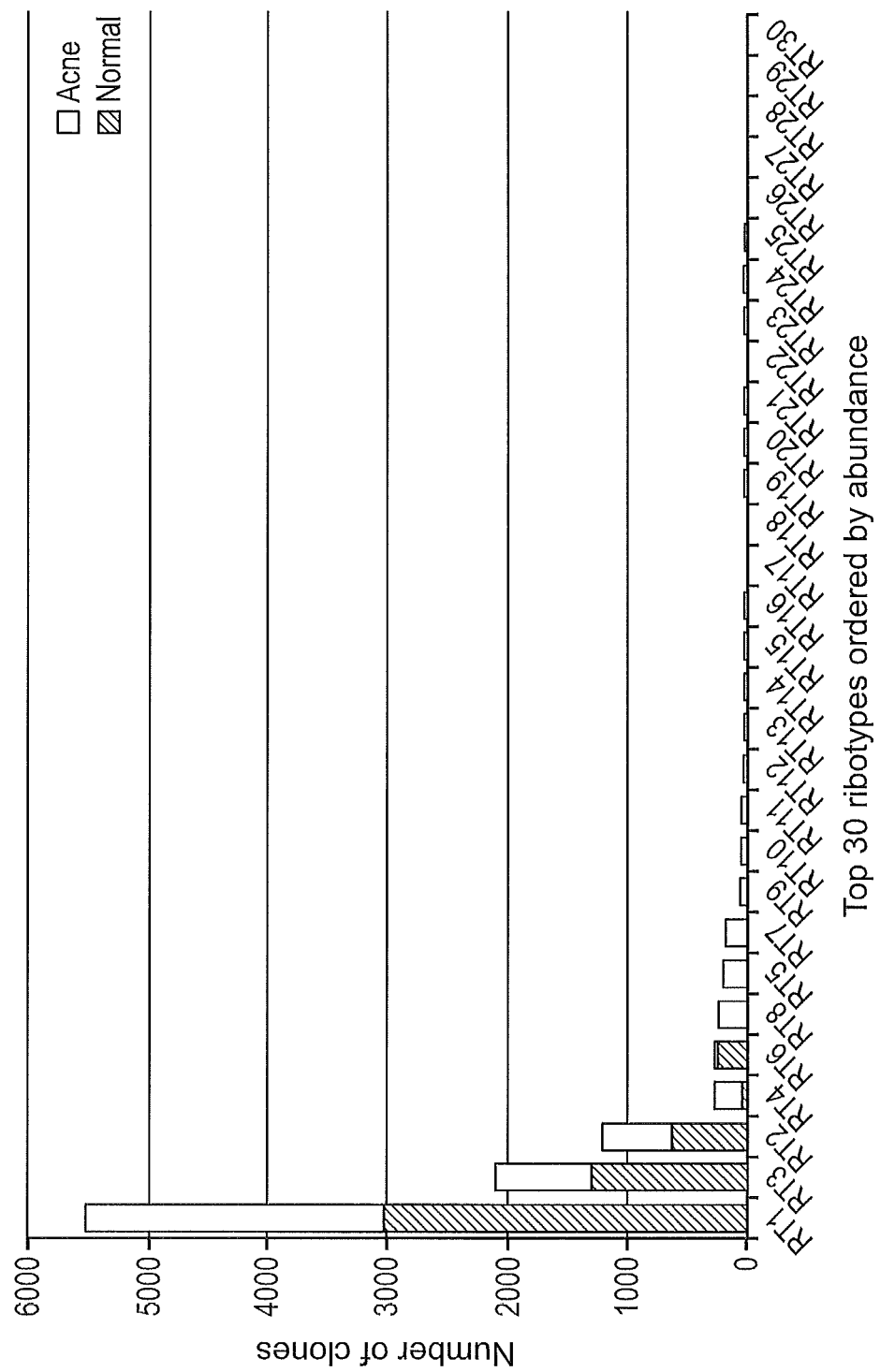
FIG. 2 shows that the rank abundance of *P. acnes* ribotypes shows a distribution similar to that seen at the higher taxonomic levels. A few highly-abundant ribotypes and a large number of rare ribotypes were observed in the samples. Some ribotypes were highly enriched in acne patients. Only the top 30 most abundant ribotypes are reflected in FIG. 2.

There was no statistically significant difference in the relative abundance of *P. acnes* when comparing acne patients and normal individuals. It was then examined whether there were differences at the strain level of *P. acnes* by extensively analyzing the *P. acnes* 16S rDNA sequences. Herein, each unique 16S rDNA sequence as a 16S rDNA allele type is called a ribotype (RT). The most abundant *P. acnes* sequence was defined as ribotype 1 (RT1) (SEQ ID NO:1). All other defined ribotypes have 99% or greater sequence identity to RT1. Similar to the distributions seen at higher taxonomical levels (Bik et al.), at the strain level a few ribotypes were highly abundant in the samples with a significant number of rare ribotypes (FIG. 2). After careful examination of the sequence chromatograms and manual correction of the sequences, a total of 11,009 ribotypes were assigned to the *P. acnes* 16S rDNA sequences. Most of the minor ribotypes were singletons. On average, each individual harbored 3±2 *P. acnes* ribotypes with three or more clones. Based on the genome sequences described below, all the sequenced *P. acnes* strains have three identical copies of 16S rDNA genes (see note below). This allowed the *P. acnes* strain populations in individuals based on the 16S rDNA sequences to be compared. The top ten major ribotypes with more than 60 clones and found in multiple subjects are shown in Table 1:

TABLE 1

Top ten most abundant ribotypes found in pilosebaceous units

| Ribotype | Nucleotide changes from RT1 | Number of subjects | Number of clones | Percentage of clones from acne patients[a] | Percentage of clones from normal individuals[b] | p-value[c] |
|---|---|---|---|---|---|---|
| RT1 | — | 90 | 5536 | 48% | 52% | 0.84 |
| RT2 | T854C | 48 | 1213 | 51% | 49% | 0.36 |
| RT3 | T1007C | 60 | 2104 | 40% | 60% | 0.092 |
| RT4 | G1058C, A1201C | 23 | 275 | 84% | 16% | 0.049 |
| RT5 | G1058C | 15 | 205 | 99% | 1% | 0.00050 |
| RT6 | T854C, C1336T | 11 | 262 | 1% | 99% | 0.025 |

TABLE 1-continued

Top ten most abundant ribotypes found in pilosebaceous units

| Ribotype | Nucleotide changes from RT1 | Number of subjects | Number of clones | Percentage of clones from acne patients[a] | Percentage of clones from normal individuals[b] | p-value[c] |
|---|---|---|---|---|---|---|
| RT7 | G529A | 10 | 188 | 99% | 1% | 0.12 |
| RT8 | G1004A, T1007C | 5 | 239 | 100% | 0% | 0.024 |
| RT9 | G1268A | 4 | 68 | 99% | 1% | 0.29 |
| RT10 | T554C, G1058C | 5 | 61 | 100% | 0% | 0.024 |

[a]The percentage was calculated after the number of clones of each ribotype was normalized by the total number of clones in acne patients (acne index).
[b]The percentage was calculated after the number of clones of each ribotype was normalized by the total number of clones in normal individuals.
[c]Mann-Whitney-Wilcoxon rank sum test.

Analysis of the top ten ribotypes showed both disease-specific and health-specific associations. The three most abundant ribotypes (RT1, RT2 and RT3) were fairly evenly distributed among acne and normal individuals. However, the next seven major ribotypes were significantly skewed in their distributions (Table 1). Ribotypes 4, 5, 7, 8, 9, and 10 were found predominantly in acne patients, with four of these six statistically significantly enriched in acne ($p<0.05$, Wilcoxon test). Ribotypes 4, 5, and 10 contain a nucleotide substitution G1058C in the 16S rDNA sequences, which has previously been shown to confer increased resistance to tetracycline (Ross et al., 1998; Ross et al., 2001). However, only a small percentage of the subjects in our study harboring these ribotypes had been treated with antibiotics (FIG. 3), therefore enrichment of these three ribotypes in the acne group was not correlated with antibiotic treatment. This is consistent with previous studies, which showed that previous use of antibiotics was not always associated with the presence of antibiotic resistant strains and that some patients who were not previously treated with antibiotics harbored strains already resistant to antibiotics (Coates et al., 2002; Dreno et al., 2001). One ribotype, RT6, although detected in only 11 subjects, was strongly associated with normal skin ($p=0.025$, Wilcoxon test) (Table 1). Its relative abundance in the normal group was similar to that found in the healthy cohort data from the Human Microbiome Project (HMP) (see FIG. 3). The percentage of positive subjects (11/52) was similar as well. Three of the 14 HMP subjects had RT6 found in the anterior nares, and one additional subject had RT6 in the left retroauricular crease.

Figure 4:
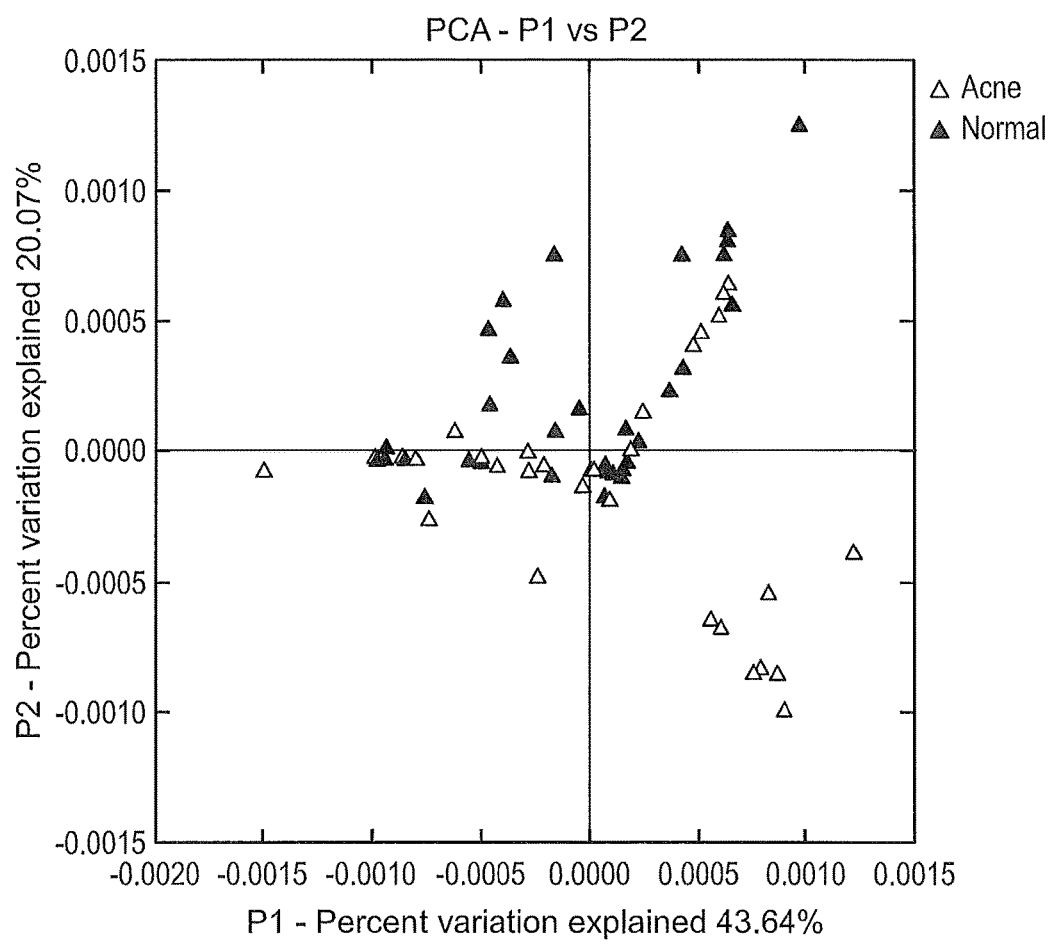
FIG. 4 shows that *P. acnes* population structures differ in acne and normal skin. *P. acnes* populations from samples were clustered using principal coordinates analysis of the weighted UniFrac distance matrix for the top ten most abundant ribotypes. The principal coordinate 1 (P1) explains 43.64% of the variation and P2 explains 20.07% of the variation. The analysis was performed using QIIME (Caporaso et al. 2010).

Based on the distributions of the top ten ribotypes, statistical analysis using several different tests showed significant differences in *P. acnes* population structure between acne and normal skin (FIG. 4). This is consistent with a principal coordinate analysis, where acne samples and normal skin samples were separated by mostly principal coordinates 1 and 2 (FIG. 4), explaining 44% and 20% of the variation, respectively.

Figure 5:
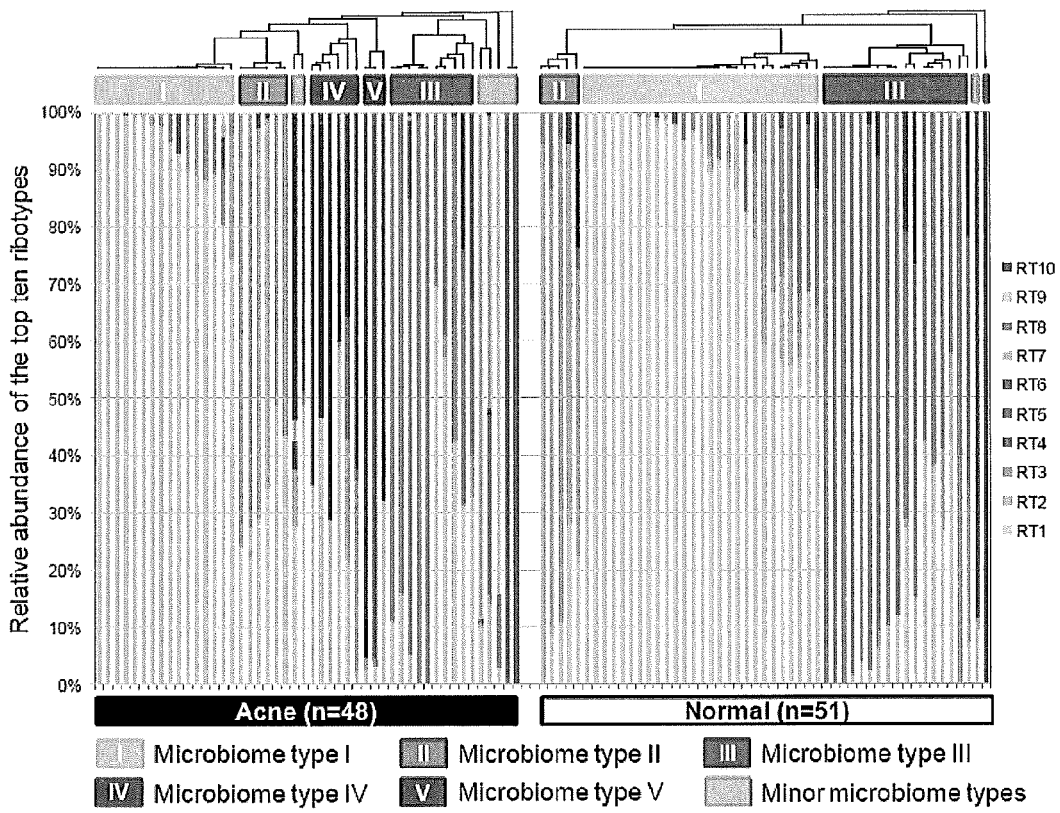
FIG. 5 shows the distribution of the top ten most abundant *P. acnes* ribotypes in acne patients and individuals with normal skin. Each column represents the percentage of the top ten ribotypes identified in each subject. The average *P. acnes* clone number per subject was 262 and the average clone number of top ten ribotypes was 100. Five major microbiome types at the *P. acnes* strain level were observed in the data. Types IV and V were mostly found in acne patients. Two samples (one from acne, one from normal skin) with fewer than 50 *P. acnes* 16S rDNA sequences are not displayed.
Figure 6:
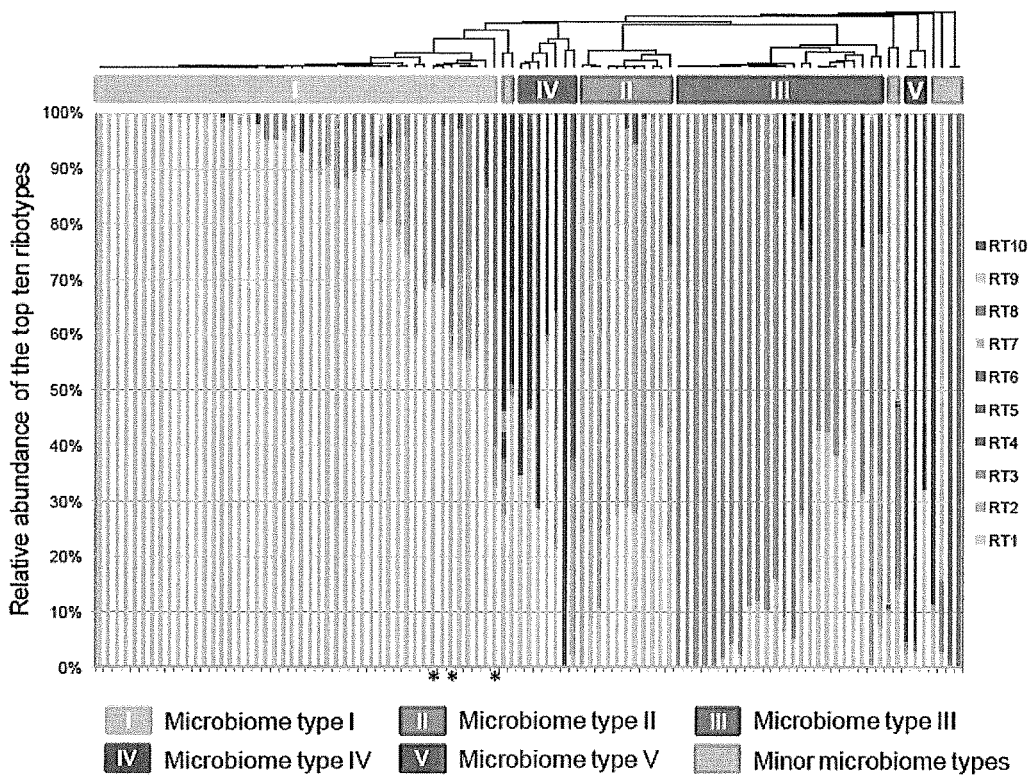
FIG. 6 shows the distribution of the top ten most abundant *P. acnes* ribotypes in all samples without separating the two groups of acne and normal skin. Each column represents the percentage of the top ten ribotypes identified in each sample. When all samples were clustered, the same five major microbiome types at the *P. acnes* strain level were observed, indicating that microbiome classification does not depend on the states of the disease. Only three out of 99 samples were clustered differently compared to the one shown in FIG. 5 (marked with asterisks). Two samples, one from acne and one from normal skin, with fewer than 50 *P. acnes* 16S rDNA sequences are not shown.

To examine whether different individuals share similar *P. acnes* population structures, the samples were clustered based on the relative abundances of the top ten ribotypes. Five main microbiome types were observed at the *P. acnes* strain level (microbiome types I to V). Types IV and V, which are dominated by *P. acnes* RT4 and RT5, respectively, were mainly found in acne patients (FIGS. 5 and 6). The same five main microbiome types were observed in the HMP data and the data from Grice et al. (Grice et al., 2009) (see FIG. 7).

Genome Sequence Analysis of 71 *P. acnes* Strains

Figure 8:
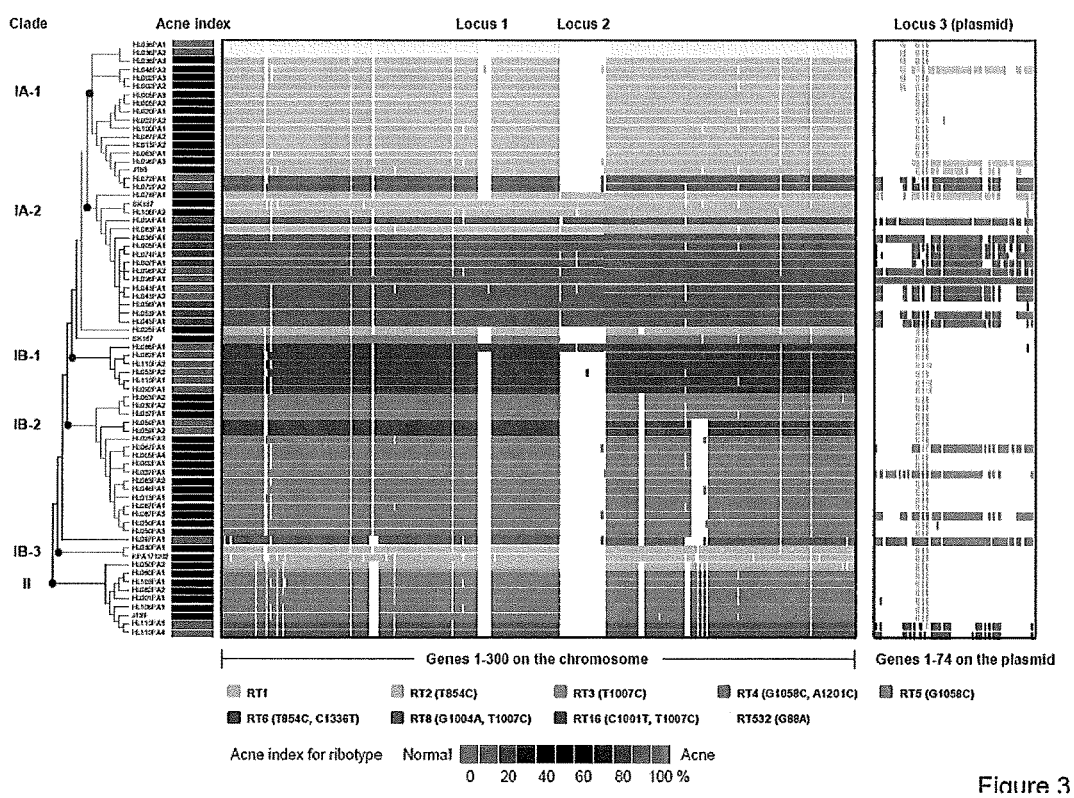
FIG. 8 indicates that the genome comparison of 71 *P. acnes* strains showed that the genomes of RT4 and RT5 are distinct from others. Two chromosomal regions, loci 1 and 2, are unique to clade IA-2 and one other genome HL086PA1. Clade IA-2 consists of mainly RT4 and RT5 that were highly enriched in acne. The presence of a plasmid (locus 3) is also characteristic of RT4 and RT5. Each row represents a *P. acnes* genome colored according to the ribotypes. Rows are ordered by the phylogeny calculated based on the SNPs in the *P. acnes* core genome. Only the topology is shown. The clades were named based on their recA types (IA, IB and II). Columns represent predicted open reading frames (ORFs) in the genomes and are ordered by ORF positions along the finished genome HL096PA1, which encodes a 55 Kb plasmid. Only the first 300 ORFs on the chromosome (on the left) and all the ORFs on the plasmid (on the right) are shown. The colored plasmid regions represent genes on contigs that match exclusively to the HL096PA1 plasmid region. The genes that fall on contigs that clearly extend beyond the plasmid region are likely to be chromosomally located and are colored in grey. Acne index for the ribotypes was calculated based on the percentage of clones of each ribotype found in acne as shown in column 5 in Table 1.
Figure 9:
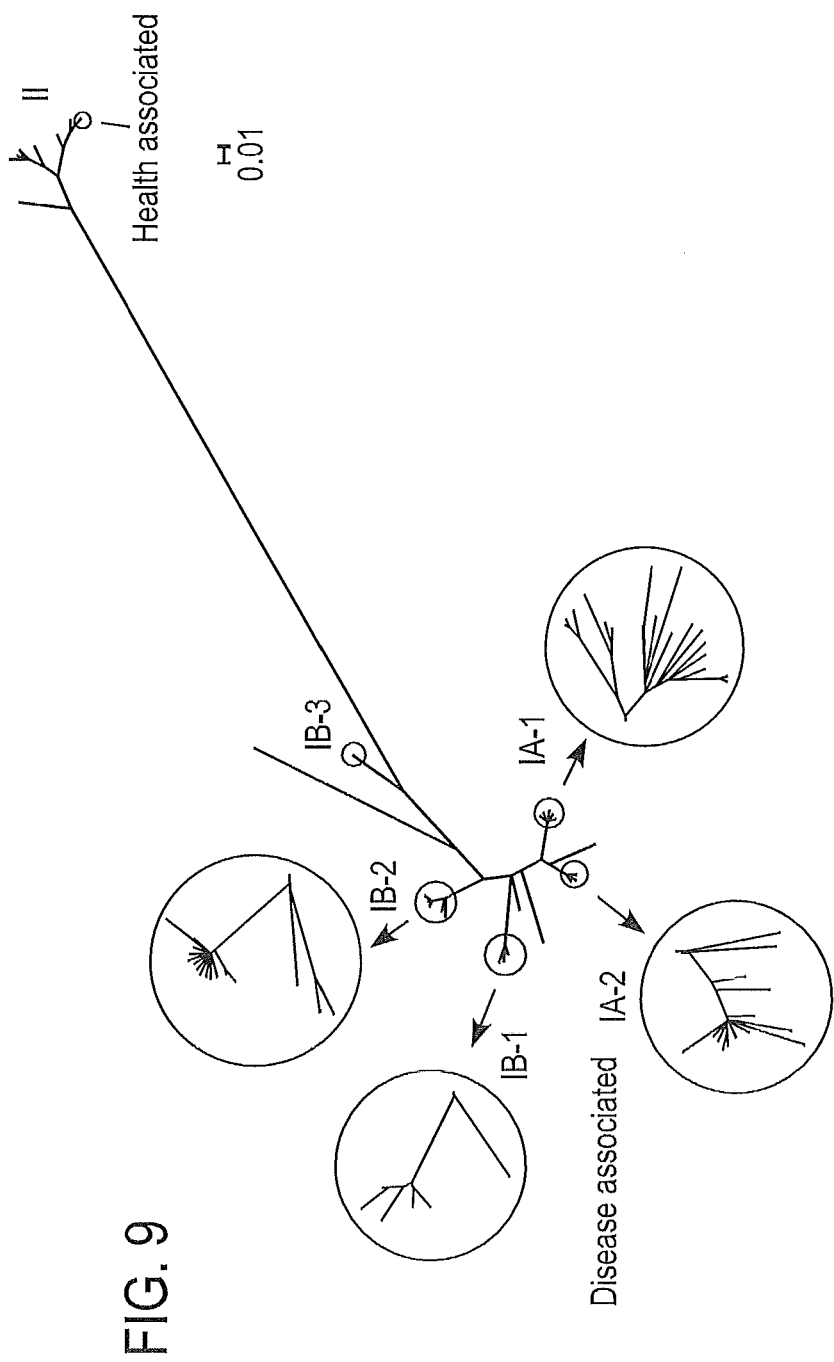
FIG. 9 shows the phylogentic tree constructed based on the 96,887 SNPs in *P. acnes* core genome, which shows that the 71 genomes cluster into distinct clades, consistent with recA types that have been used to classify *P. acnes* strains. The 16S ribotypes of the genomes represent the relationship of the lineages to a large extent. At one end of the tree, clades IA-2 and IB-1 mainly consist of the ribotypes enriched in acne, and at the other end of the tree, RT6 in clade II was mainly found in healthy subjects. Bootstrap test with 1,000 replicates were performed. The distances between the branches were calculated based on the SNPs in the core genome and do not represent the non-core regions of each genome. The enlarged branches were colored according to the 16S ribotypes as shown in FIG. 8.

All of the top ten most abundant ribotypes differ from RT1 by only one or two nucleotide changes in the 16S rDNA sequence (Table 1). To determine whether such small changes in the 16S rDNA sequence reflect the lineages and evolutionary history at the genome level, 66 *P. acnes* isolates representing major ribotypes 1, 2, 3, 4, 5, 6, and 8 as well as two minor ribotypes, 16 and 532, were selected for genome sequencing. The genomes of these 66 isolates were fully sequenced and assembled to high quality drafts or complete genomes with 50× coverage or more. Five other *P. acnes* genomes, KPA171202 (Bruggemann et al., 2004), J165, J139, SK137, and SK187, were publicly-available and were included in the analysis. A phylogenetic tree based on 96,887 unique single nucleotide polymorphism (SNP) positions in the core genome obtained from these 71 *P. acnes* genomes was constructed. Most of the genomes with the same ribotypes clustered together. The tree indicates that the 16S rDNA ribotypes do represent the relationship of the lineages to a large extent and that 16S rDNA sequence is a useful molecular marker to distinguish major *P. acnes* lineages (FIGS. 8 and 9).

Genetic Elements Detected in *P. acnes*

Figure 10:
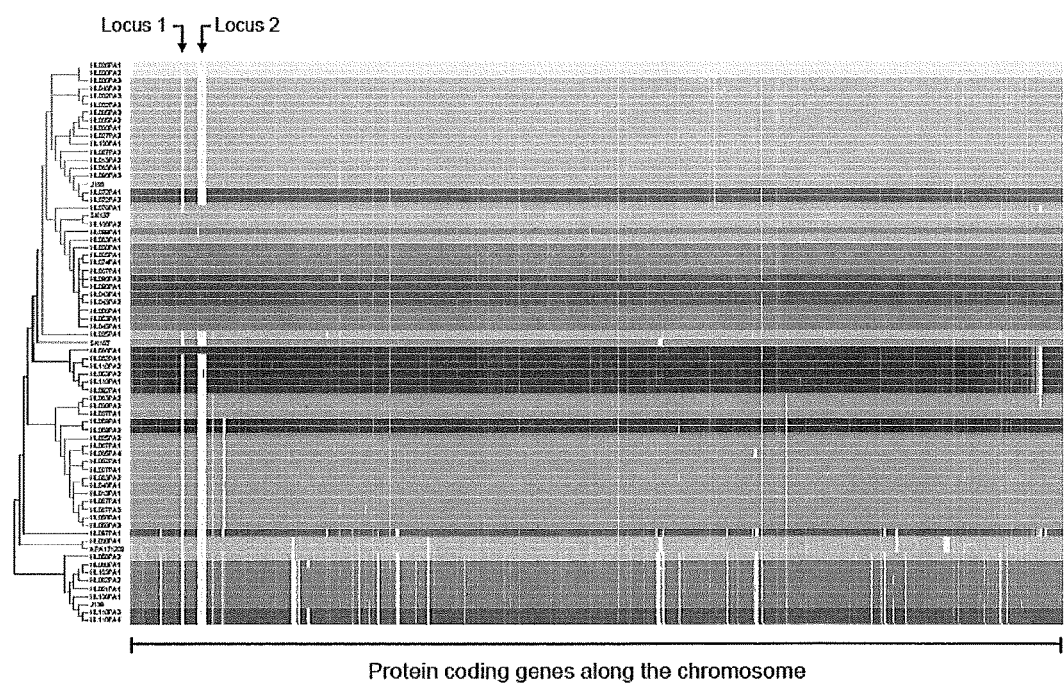
FIG. 10 provides a genome comparison of 71 *P. acnes* strains and shows that the genomes of RT4 and RT5 are distinct from others. All of the predicted open reading frames (ORFs) encoded on the chromosome are shown. Each row represents a *P. acnes* genome colored according to the ribotypes. Rows are ordered by the phylogeny calculated based on the SNPs in *P. acnes* core genome. Only the topology is shown. Columns represent ORFs in the genomes and are ordered by their positions along the finished genome HL096PA1. Loci 1 and 2, which are unique to mainly RT4 and RT5 strains, and locus 4, which is unique to mainly RT8 strains, can be seen in the figure.
Figure 11:
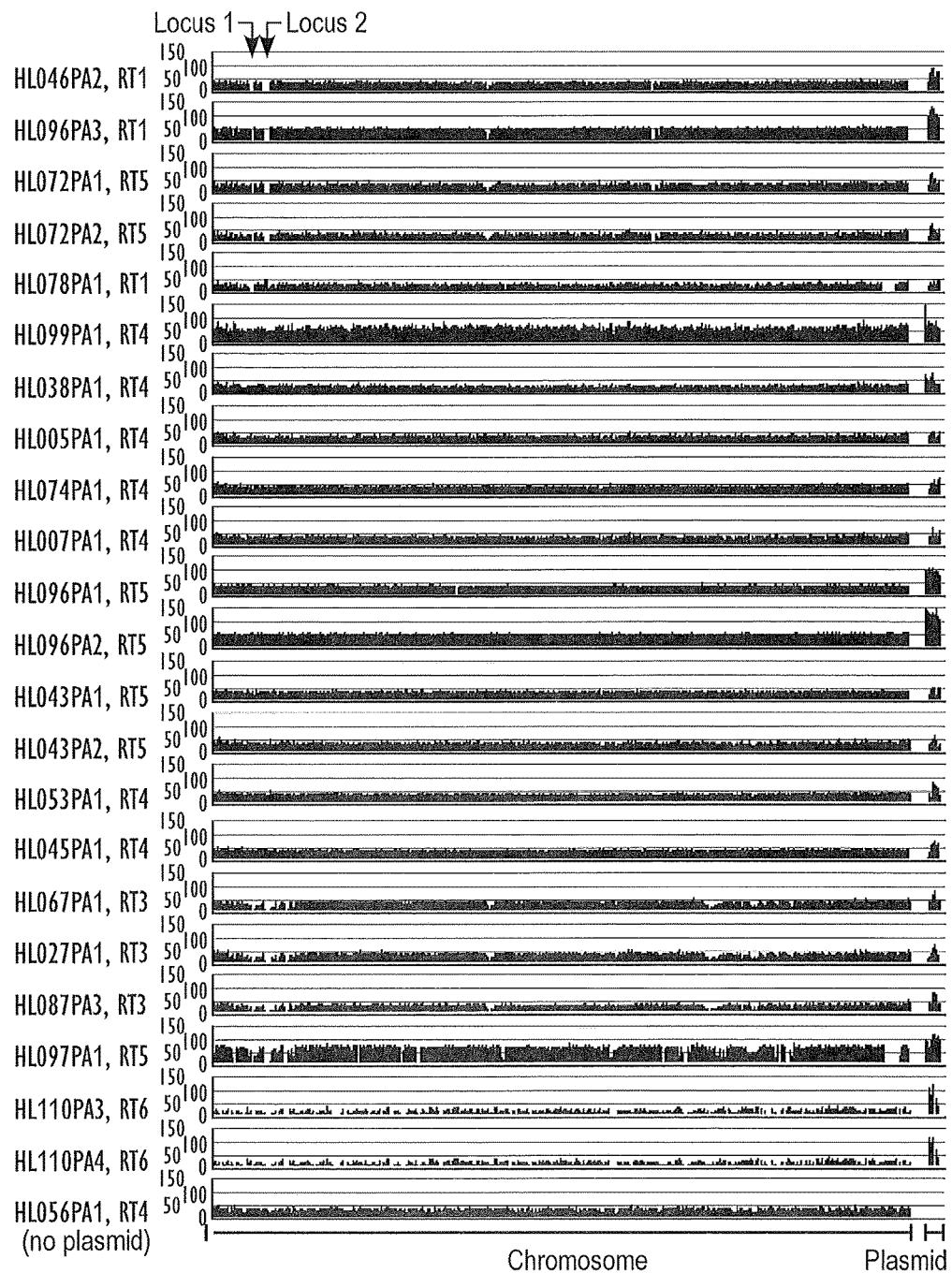
FIG. 11 provides a sequence coverage comparison between the chromosome and the plasmid region in all genomes harboring a putative plasmid, which shows that the copy number of plasmid ranges from 1 to 3 per genome. The X-axis represents the DNA sequences along the chromosome based on the coordinates of the finished genome HL096PA1, followed by plasmid sequences. The Y-axis represents the sequence coverage. The genomes were in the same order as in FIG. 8, except HL056PA1 (as a negative control).
Figure 12:
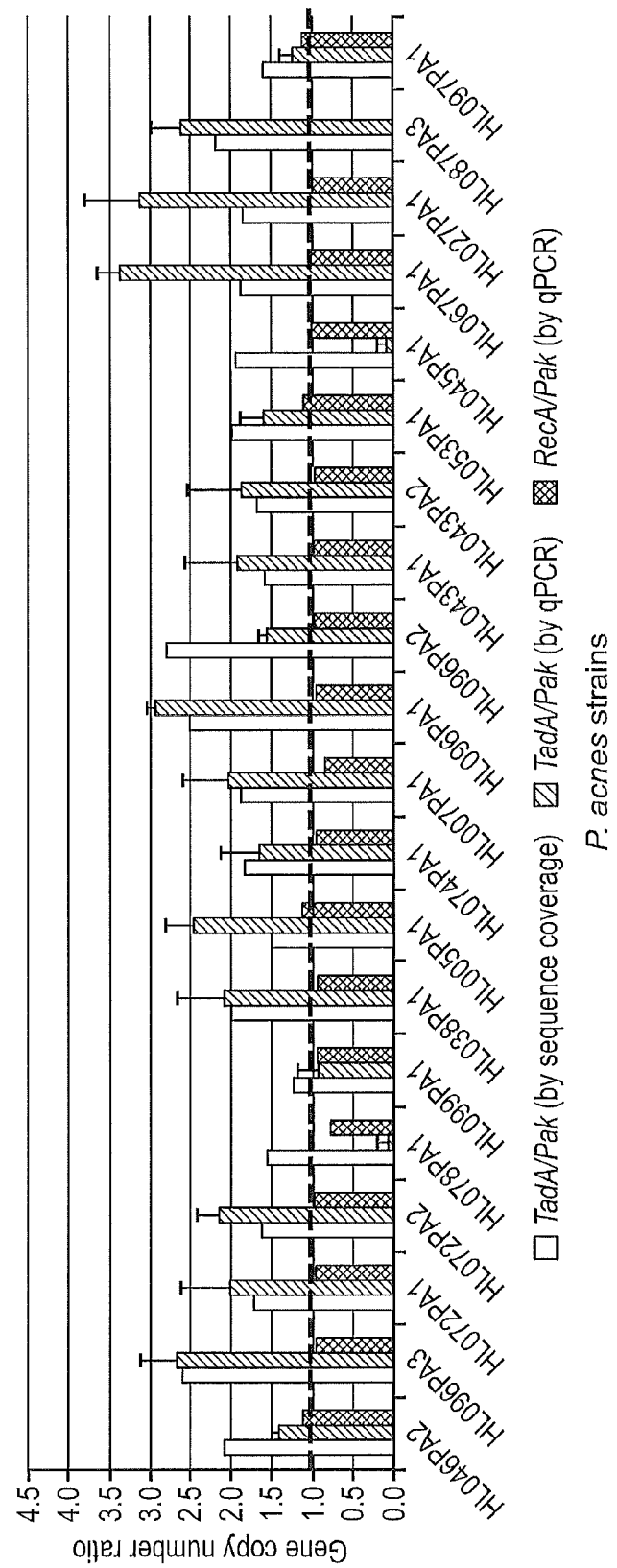
FIG. 12 reflects that quantitative PCR (qPCR) confirmed that the copy number of plasmid in each genome is 1-3 as predicted from sequence coverage comparison. Pak and RecA are housekeeping genes located on the chromosome and TadA is a conserved gene in the Tad locus located on the plasmid. The copy number ratio between TadA and Pak ranges from 1 to 3 in genomes, while the ratio between RecA and Pak is 1 in all the genomes. The TadA gene in HL078PA1 and HL045PA1 had amplification in late cycles in qPCR. Conventional PCR confirmed the amplification of TadA in these two strains, while other strains without the plasmid showed no amplification (data not shown).

A comparative genome analysis among all 71 genomes grouped by ribotypes was performed. The analysis revealed genetic elements by which acne-associated strains could contribute to acne pathogenesis and the elements by which health-associated strains could contribute to maintaining skin health. Specifically, now known are the unique genome regions of RT4 and RT5, which had a strong association with acne, and RT6, which was found enriched in normal skin. Three distinct regions, loci 1, 2, and 3, were found almost exclusively in strains that belong to clade IA-2 in the phylogenetic tree. Clade IA-2 consists of mainly RT4 and RT5 (FIGS. 8 and 10). Loci 1 and 2 are located on the chromosome. Locus 1 contains prophage-related genes and appears to be a genomic island. Locus 2 has plasmid integration sites and may be derived from a plasmid sequence. Locus 3 appears to be on a large mobile genetic element, likely a plasmid. The plasmid is approximately 55 Kb long and has inverted terminal repeats according to the finished genome HL096PA1. The sequence data suggest that the plasmid is linear and possibly originated from a phage (Hinnebusch and Tilly (1993)). All but one of the fifteen genomes of RT4 and RT5 have at least 60% of the genes of the plasmid represented, and all of them have regions homologous to the inverted terminal repeats in the plasmid, suggesting that they harbor the same or a similar linear plasmid (FIG. 8). The copy number of the plasmid in the genomes ranges from 1 to 3 based on genome sequencing coverage, which was confirmed by quantitative PCR (FIGS. 11 and 12).

The fact that acne-enriched RT4 and RT5 strains carry a linear plasmid and two unique loci of genomic islands indicates that these plasmid and chromosomal regions play a role in acne pathogenesis. In fact, the linear plasmid encodes a tight adhesion (Tad) locus, which has been suggested to play a role in virulence in other organisms (Kachlany et al., 2000; Schreiner et al., 2003). The complete Tad locus is found in all but one of the fifteen genomes of RT4 and RT5, and is only occasionally found in other ribotypes. Additionally, in locus 2, a Sag gene cluster is encoded, which has been shown to contribute to hemolytic activity in pathogens (Fuller et al., 2002; Humar et al., 2002; Nizet et al., 2000). FIG. 6 summarizes the genes that are mostly unique to RT4 and RT5, several of which play essential roles in virulence in other organisms. Some of these genes encoded in RT4 and RT5 increase virulence, promote stronger adherence to the human host, or induce a pathogenic host immune response.

In the genome comparison analysis, it was found that all the genomes of RT2 and RT6 encode Clustered Regularly Interspaced Short Palindromic Repeats (CRISPR). Among the sequenced genomes, RT2 and RT6 are the only ribotypes encoding CRISPR. CRISPR have been shown to confer protective "immunity" against viruses, phages, and plasmids (Horvath and Barrangou, 2010; Makarova et al., 2011). The CRISPR locus encoded in *P. acnes* consists of a series of cas genes—cas3, cse1, cse2, cse4, cas5e, cse3, cas1, and cas2, which are homologous to the CRISPR locus reported in *E. coli* (FIG. 510) and the CRISPR4 locus in *Streptococcus thermophilus* (Horvath and Barrangou, 2010).

CRISPR arrays are composed of a cluster of identical repetitive sequences separated by spacer sequences of similar length but with different nucleotide sequences. It has been found that spacer sequences are identical or with one or two mismatches to phage or plasmid DNA sequences. A total of 39 spacer sequences were found in eight *P. acnes* strains, 25 of which were unique as shown in Table 2.

TABLE 2

| Ribotype | Strain | Spacer number | Spacer sequence | BLAST result | Match Found |
|---|---|---|---|---|---|
| RT2 | HL001PA1 | 1 | CATGGCCTGCACACCAGGCGCTTTAGCACCT | No hits | |
| | | 2 | CATGGCCTGCACACCAGGCGCTTTAGCACCT | No hits | |
| | | 3 | CATGGCCTGCACACCAGGCGCTTTAGCACCT | No hits | |
| | | 4 | GGCGTATGACGAGTTGTGTCGGCGTTTCCTC | P. acnes phage PA6 gp15 (minor tail protein) | |
| | | 5 | CGGTGTTAACGGCTTGCCTGGCTTGGATGGAG | No hits | |
| RT2 | HL060PA1 | 1 | CGCCTACCGTCAGCTGACTCACGCCTCCGCGTT | No hits | Locus 3 |
| | | 2 | TCACACCAGTCATCAGCGTCATAGTCCTCTCGG | No hits | |
| RT2 | HL082PA2 | 1 | GGCTCAGCCCTGCCCGATGCCTACGCCAAATGG | C. leptum DSM 753 CLOLEP_00129 (cell wall-associated hydrolases (invasion-associated proteins)) | Locus 3 |
| | | 2 | TCACACACCAGTCATCAGCGTCATAGTCCTCTCGG | No hits | |
| RT2 | HL103PA1 | 1 | CACCGGGCCCATCCCGTCGGCCTCCTGAAAGG | C. leptum DSM 753 CLOLEP_00135 | |
| RT2 | HL106PA1 | 1 | GATCGAGTTGGCTGAGTCGAAGGTGTTGCGGTT | P. acnes phage PA6 gp16 (conserved protein) P. acnes phage PAD20 gp16 | |
| | | 2 | CTGCTCATCGCTCAGCTCCTGCGCCTCATCACA | No hits | |
| | | 3 | CTGCGCCAACGCCGCATCGATCCGAATACGG | P. acnes phage PA6 gp3 (phage portal protein) P. acnes phage PA6 gp7 (conserved protein) | |
| | | 4 | CGCAGACAATCTCAGAAGGCCACAACAAGTTCGT | P. acnes phage PAD20 gp7 P. acnes phage PAS50 gp7 | |
| | | 5 | CAAATCACCCAAGCCAACACGCCGCCACCACC | No hits | |
| | | 6 | TGTCACCGATTCAATGTATCTATGAGTGGTGTA | No hits | Locus 3 |
| | | 7 | TTGGGTGGGTGAGGTCGGGTCGTCAGTCATGAG | No hits | |
| | | 8 | GTCGATGTCGAGATTGCCTGGGGGTCCATGTC | Clostridium leptum DSM 753 CLOLEP_00142 | Locus 2 |
| | | 9 | ACGTCGTGAACGTACCCCTTGACGAGACGGCA | No hits | |
| RT2 | J139 | 1 | CGAGGGCTACCACGTGGTCGATTTGGACTGTCG | C. leptum DSM 753 CLOLEP_00167 P. acnes 5K137 HMPREF0675_3193 (domain of unknown function) | |
| | | 2 | CAGGCGCTCCACTCCCTCGCCCTGGCCACCAAC | No hits | |
| RT6 | HL110PA3 HL110PA4 | 1 | CTATGTGGACAGTGTTGGTTACTGTGGGGGAA | P. acnes phage PA6 intergenic region between gp45 and gp46 | |
| | | 2 | GCACTGCCACCGATATCGTGTGGCTGTCACTTG | No hits | |
| | | 3 | CCCAGACAACCTCGACAACCTGTTCAGGGGATG | P. acnes phage PAS50 gp25 P. acnes phage PAD20 gp34 (mutidrug resistance protein-like transporters) | |
| | | 4 | CATGGCTAGCCCGGATTTTTGCTGCCTGAGCG | P. acnes phage PAD20 gp34 (DNA helicase) P. acnes phage PA6 gp14 (tape measure protein) | |

TABLE 2-continued

| Ribotype | Strain | Spacer number | Spacer sequence | BLAST result | Match Found |
|---|---|---|---|---|---|
| | | 5 | CGGCCTGCGGCAGATTTTGTTGCGTTGAATCC | P. acnes phage PAD20 gp14 (tape measure protein) P. acnes phage PAS50 gp14 (tape measure protein) P. acnes phage PA6 gp32 (CHC2 zinc finger) | |
| | | 6 | CGGGCAGAGGATGTGTTGCTCGTTCCTGGATGG | P. acnes phage PAD20 gp32 (DNA primase) P. acnes phage PAS50 gp32 (DNA primase) P. acnes phage PAD42 major head protein gene P. acnes phage PAD20 major head protein gene P. acnes phage PAD9 major head protein gene P. acnes phage PAS40 major head protein gene P. acnes phage PAS12 major head protein (gene | |
| | | 7 | GTTACGCTGGAACCCCCAATGAACACGCGAGAA | P. acnes phage PAS10 major head protein gene P. acnes phage PAD21 major head protein gene P. acnes phage PAS2 major head protein gene P. acnes phage PA6 gp6 (Phage capsid family) P. acnes phage PAS50 gp6 major head protein gene C. leptum DSM 753 CLOLEP_00167 | Locus 2 |
| | | 8 | CGAGGGCTACCACGTGGTCGATTTGGACTGTCG | P. acnes 5K137 HMPREF0675 3193 (Domain of unknown function) | |
| | | 9 | CAGGCGCTCCACTCCCCTGCCCCTGGCCACCAAC | No hits | |

Abbreviations: BLAST, Basic Local Alignment Search Tool; CRISPR, Clustered Regularly Interspaced Short Palindromic Repeat; C. leptum, Clostridium leptum; P. acnes, Propionibacterium acnes; RT, ribotype.

As expected, most of the identifiable spacers target to known *P. acnes* phage sequences. However, among the unique CRISPR spacer sequences, one matched locus 2 on the chromosome and three matched the plasmid region (locus 3) in *P. acnes* genomes of mainly RT4 and RT5. This suggests that these loci may have been acquired by RT4 and RT5 strains, while the genomes of RT2 and RT6 may be capable of protecting against the invasion of the plasmids or other foreign DNA through the CRISPR mechanism.

Discussion

The foregoing study of the human skin microbiome associated with acne provides the first portrait of the microbiota of pilosebaceous units at the bacterial strain level. Since *P. acnes* is the major skin commensal bacterium found in both acne and healthy skin, this strain-level analysis is important to help understand the role of *P. acnes* in acne pathogenesis and in skin health. A strong association between strains of RT4 and RT5 with acne and a strong association between strains of RT6 and healthy skin, each with unique genetic elements, has been shown. Other *P. acnes* strains, including ribotypes 7, 8, 9, and 10, or interactions among different strains, may also contribute to the development of the disease. In addition, host factors, such as hormone level, sebum production, and physical changes in the pilosebaceous unit, may also play a role in acne pathogenesis.

The foregoing metagenomic approach in revealing the association of *P. acnes* strains with the disease or health is more powerful than previous studies using traditional methods (Lomholt and Kilian, 2010; McDowell et al., 2011). Because the skin microbiota of each individual and each skin site may harbor "good," "neutral," and "bad" strains at the same time, which may have different growth rates under in vitro culturing conditions, culturing a few isolates from a disease lesion or healthy skin site may not provide an accurate and unbiased measurement of the association of the strains with the disease or health. The sampling technique and disease associations in the foregoing study did not depend on sampling locations, on the presence of lesions in the sampling field, or on inherently biased culture techniques. While sampling lesional skin intentionally may yield interesting results, these results would not be capable of defining the disease associations that unbiased sampling can. The metagenomic approach employed in the foregoing study to identify underlying strain differences in acne may also be applied to the study of other disease/health associations with commensal or pathogenic bacteria.

Materials and Methods

Subjects

Subjects with acne and subjects with normal skin were recruited from various clinics in Southern California including private practice, managed care, and public hospital settings, as well as outside of dermatology clinics, to best represent the diversity of populations and history of medical care. The subject data are available at dbGaP (www.ncbi.nlm.nih.gov/projects/gap/cgi-bin/study.cgi?study_id=phs000263.v1.p1). The diagnosis of acne was made by board-certified dermatologists. The presence of acne was graded on a scale of 0 to 5 relating closely to the Global Acne Severity Scale (Dreno et al., 2011). Grades were recorded for both the face and the nose separately where zero represents normal skin and 5 represents the most severe inflammatory cystic acne. In acne patients, the grades of the face ranged from 1 to 5 with an average of 2.1, and the grades of the nose ranged from 0 to 2 with an average of 0.3.

Figure 3:
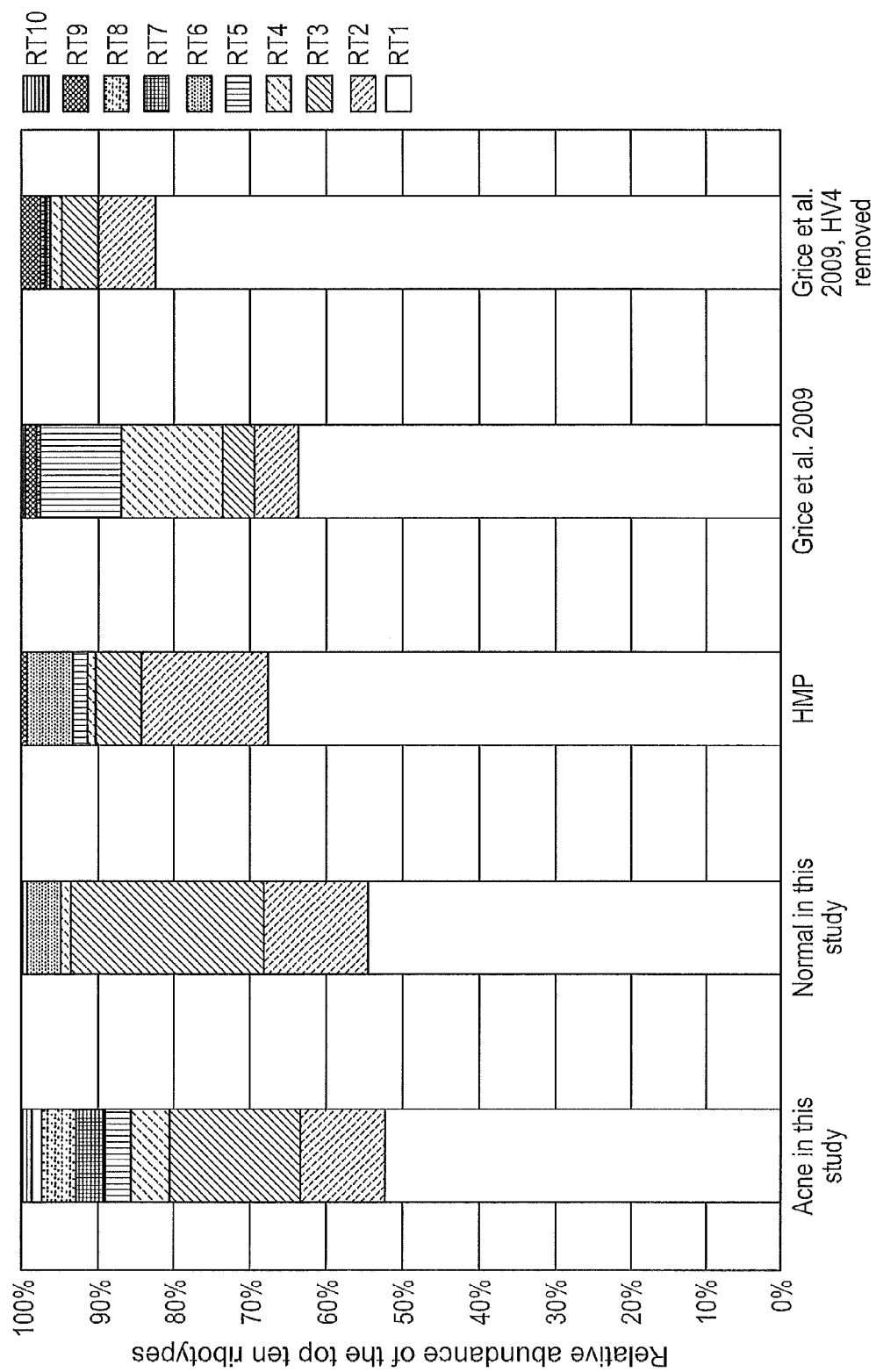
FIG. 3 shows that the most abundant *P. acnes* ribotypes in pilosebaceous units were also abundant at other body sites. The major ribotypes found in acne patients and normal individuals were compared to the datasets from the HMP and Grice et al. (2009). The top three ribotypes are the most abundant ones in different datasets. The excess RT4 and RT5 seen in the dataset by Grice et al. (2009) was due to one subject, HV4, whose *P. acnes* strain population was dominated by these two ribotypes at every skin site sampled. After removal of this subject, the ribotype distribution is similar to the HMP samples and the normal skin samples studied. RT6 is also found abundant in the HMP dataset, which were collected from healthy individuals.

The presence of scarring was also noted. Subjects with normal skin were determined by board-certified dermatologists and were defined as people who had no acneiform lesions on the face, chest, or back. They were also excluded if they had other skin problems that the investigators felt would affect sampling or the microbial population on the skin. Among the 101 subjects, 59 were female (31 acne patients and 28 normal subjects) and 42 were male (18 acne patients and 24 normal subjects). The average age of the acne cohort was 22.2 and the average age of the normal cohort was 29.6. There was no significant difference in ethnicity between the acne and normal populations. The subjects responded to a written questionnaire, administered by a physician or a well-trained study coordinator who went over each question with the subjects. Most of the subjects had not been treated for acne in the past or were not being treated when samples were collected (FIG. 3). Only nine out of 78 subjects, who provided treatment information, were being treated for acne when samples were taken. Among the nine subjects, two were being treated with antibiotics, five were being treated with topical retinoids, one was being treated with both antibiotics and retinoids, and one did not list the treatment. Subjects were asked for acne treatment history in the past (anytime in their life). Eighteen out of 73 subjects, who provided treatment history, had been treated for acne in the past. Among them, seven had been treated with antibiotics, eight had been treated with retinoids, two had been treated with both antibiotics and retinoids, and one did not list the treatment. All subjects provided written informed consent. All protocols and consent forms were approved by both the UCLA and Los Angeles Biomedical Research Institute IRBs. The study was conducted in adherence to the Helsinki Guidelines.

Samples

Skin microcomedone (white head or black head) samples were taken from the nose of the subjects using Bioré Deep Cleansing Pore Strips (Kao Brands Company, Cincinnati, Ohio) following the instruction of the manufacturer. Clean gloves were used for each sampling. After being removed from the nose, the strip was immediately placed into a 50 mL sterile tube and kept on ice or at 4° C. The cells were lysed within four hours in most of the cases.

Metagenomic DNA Extraction, 16S rDNA Amplification, Cloning, and Sequencing

Individual microcomedones were isolated from the adhesive nose strip using sterile forceps. Genomic DNA was extracted using QIAamp DNA Micro Kit (Qiagen, Valencia, Calif.). 16S rDNA was amplified and cloned according to the protocol by HMP, which is described in detail in Supplementary Information. Nearly full length sequences were obtained by Sanger method.

16S rDNA Sequence Analysis

Base calling and quality was determined with Phred (Ewing and Green, 1998; Ewing et al., 1998). Bidirectional reads were assembled and aligned to a core set of NAST-formatted sequences (rRNA16S.gold) using AmosCmp16Spipeline and NAST-ier (Haas et al., 2011). Suspected chimeras were identified using ChimeraSlayer and WigeoN (Haas et al., 2011). 16S rDNA sequences were extensively manually examined. Chromatograms were visually inspected at all bases with a Phred quality score <30. Appropriate corrections were applied. QIIME (Caporaso et al., 2010) was used to cluster the sequences into OTUs.

*P. acnes* Isolation and Genotyping

Colonies with the macroscopic characteristics of *P. acnes* were picked from each sample plate and were passed twice.

The ribotype of each isolate was determined by PCR amplification and sequencing of the full length of the 16S rDNA gene by Sanger method.

Whole Genome Shotgun Sequencing, Assembly, and Annotation

Genome HL096PA1 was sequenced using Roche/454 FLX and was assembled using a combination of PHRAP/CONSED (Gordon et al., 1998) and GSMAPPER (Roche, Branford, Conn.) with extensive manual editing in CONSED. The remaining 65 genomes were sequenced using Illumina/Solexa GAIIx (Illumina, San Diego, Calif.). Sequence datasets were processed by quality trimming and were assembled using Velvet (Zerbino and Birney, 2008). Coding sequences were predicted using GeneMark (Borodovsky and McIninch, 1993) and GLIMMER (Salzberg et al., 1998). The final gene set was processed through a suite of protein categorization tools consisting of Interpro, psort-b and KEGG. A more detailed protocol can be found at hmpdacc.org/doc/sops/reference_genomes/annotation/WUGC_SOP_DACC.pdf.

Comparative Genome Analysis

Seventy-one *P. acnes* genome sequences were compared using Nucmer (Kurtz et al., 2004). Phylogenetic analysis was performed using MEGA5 (Tamura et al., 2007). CRISPRFinder (Grissa et al., 2007) was used to identify the CRISPR repeat-spacer sequences.

Supplementary Information 16S rDNA Sequence of KPA171202

All sequenced *P. acnes* genomes encode three copies of 16S rRNA genes, which are identical within each isolate, except KPA171202. Based on the KPA171202 genome (Bruggemann et al., 2004), one copy of the 16S rRNA gene has one nucleotide difference from the other two identical copies of RT1. However, this mutation was never observed in the 16S rDNA dataset. Multiple clones of 16S rDNA gene from KPA171202 were amplified, cloned, and sequenced and a sequence harboring this mutation was not found. Thus, KPA171202 also has three identical copies of 16S rDNA.

Comparison of *P. acnes* Strain Distribution to Other Human Microbiome Datasets

Figure 7:
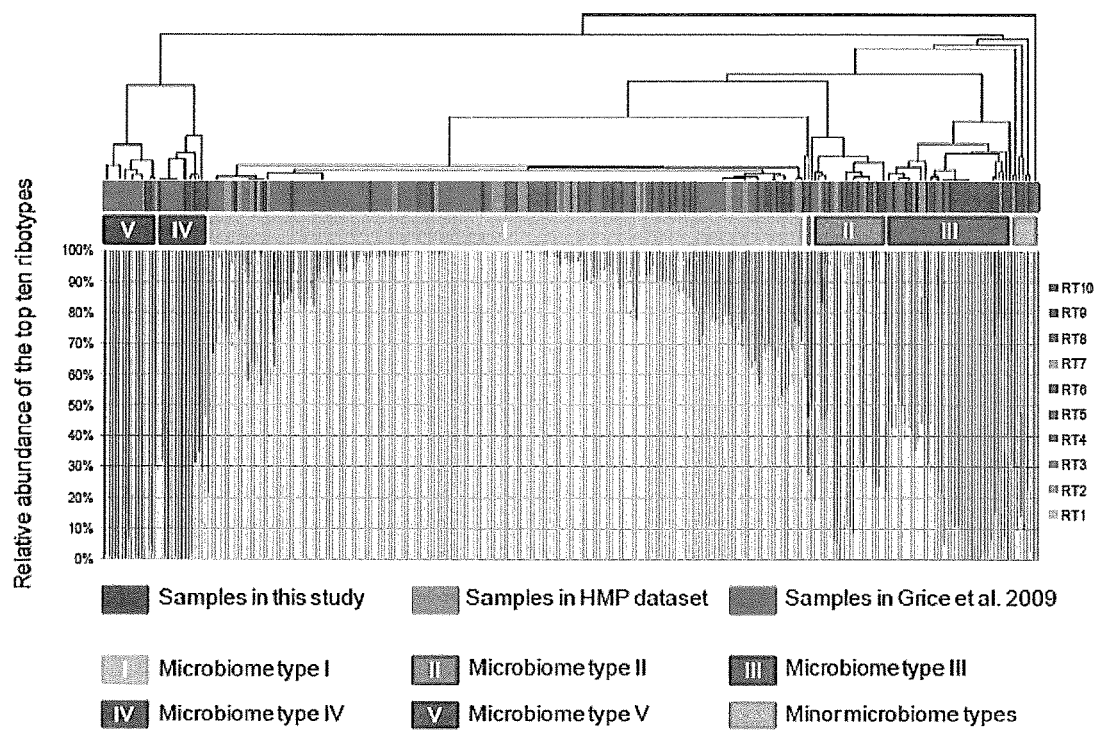
FIG. 7 shows that the same five major microbiome types were observed in multiple datasets. Samples from the study, HMP, and Grice et al. (2009) were clustered together based on the top ten most abundant *P. acnes* ribotypes. In total, 284 samples were included. Each column represents the percentage of the top ten ribotypes identified in each sample. Both HMP samples and samples from Grice et al. (2009) were collected from healthy individuals, therefore the percentage of microbiome types IV and V are under-represented in the analysis. Samples with fewer than ten sequences of the top ten ribotypes were not included.

To determine whether the *P. acnes* ribotypes and their relative abundances measured in this study are unique to pilosebaceous units, a similar analysis to the microbiome 16S rDNA data from the Human Microbiome Project (HMP) and the data from Grice et al. (2009) were applied. Both datasets were obtained from healthy subjects. The relative abundance of the major ribotypes in healthy subjects from the study was largely similar to that found in these two datasets despite the fact that they were sampled from different anatomical sites (FIG. 3). RT6 (6.3%) was found to be more abundant than RT4 and RT5 combined (2.8%) in the HMP data, similar to those found in the normal cohort where RT6 represents 4.8% and RT4 and RT5 combined represent 1.2% of the clones. The same five main microbiome types were observed in the two datasets (FIG. 7).

Genome Clustering and Phylogenetic Tree

The recA gene has been widely used to classify *P. acnes* strains into four known types: IA, IB, II, and III (McDowell et al., 2008; McDowell et al., 2005). The phylogenetic tree of the 71 genomes based on the SNPs in the core genome matched the recA types perfectly except one isolate, HL097PA1. Most of the genomes with ribotypes 1, 4, 5, and 532 were grouped to recA Type IA clade, which can be further divided into subclades IA-1 and IA-2. Clade IA-2 is composed of mostly RT4 and RT5. RT4 and most of RT5 genomes seem to belong to the same lineage with very similar genome sequences. All the isolates with ribotypes 3, 8, and 16, who share the mutation of T1007C in the 16S rDNA gene, were grouped to recA Type IB clade. Most of the RT3 genomes form a subclade IB-2 and RT8 genomes form a subclade by themselves, IB-1, which was highly associated with acne. Notably, RT2 and RT6, who share T854C mutation, have a more distant phylogenetic relationship to other ribotypes, and were grouped to the recA Type II clade. This is consistent with previous studies (Lomholt and Kilian, 2010; McDowell et al., 2005). *P. acnes* isolates with recA type III were not found in the samples.

The associations of *P. acnes* lineages with health and disease states were further analyzed. There was a clear shift of the association strength of the clades with acne along the phylogenetic tree (FIG. 9). The three sequenced ribotypes identified as being strongly associated with acne (RT4, RT5, and RT8) were found at one end of the tree in clades IA-2 and IB-1, while the RT6 identified as being associated with normal skin was at the other end of the tree at the tip of clade II (FIG. 9).

Antibiotic Resistance

*P. acnes* ribotypes 4, 5, and 10 have a single nucleotide substitution G1058C in the 16S rDNA sequences, which has previously been shown to confer increased resistance to tetracycline (Ross et al., 1998a; Ross et al., 2001). In addition to the substitution in the 16S rDNA sequences, it was determined that all the strains of RT4 and RT5 that were sequenced have a nucleotide substitution in the 23S rDNA sequences, which confers increased resistance to a different class of antibiotics, erythromycin and clindamycin (Ross et al., 1997; Ross et al., 1998b). It was experimentally confirmed that these isolates, except two that were uncultured, were resistant to tetracycline, erythromycin, and clindamycin.

It was also examined whether the enrichment of these ribotypes in the acne group could be due to antibiotic treatment. However, in the study only a small percentage of the subjects harboring ribotypes 4, 5, or 10 were treated with antibiotics (Table S2).

TABLE S2

Past and current treatments of the subjects

| | Group | | | |
|---|---|---|---|---|
| | Acne | | Normal | |
| | Number of subjects | | | |
| | 49 | | 52 | |
| | with RT4, RT5, or RT10 | without RT4, RT5, and RT10 | with RT4, RT5, or RT10 | without RT4, RT5, and RT10 |
| Number of subjects in each subgroup | 20 | 29 | 9 | 43 |
| Subjects reported on current treatment | 14 | 25 | 8 | 31 |
| no treatment | 10 | 21 | 8 | 30 |
| antibiotics | 0 | 2 | 0 | 0 |
| retinoids | 3 | 2 | 0 | 0 |
| antibiotics and retinoids | 0 | 0 | 0 | 1 |
| unknown | 1 | 0 | 0 | 0 |
| Subjects reported on past treatment | 12 | 22 | 8 | 31 |
| no treatment | 5 | 16 | 6 | 28 |
| antibiotics | 2 | 4 | 0 | 1 |
| retinoids | 4 | 1 | 1 | 2 |
| antibiotics and retinoids | 1 | 0 | 1 | 0 |
| unknown | 0 | 1 | 0 | 0 |

Eighteen of the 29 subjects who harbored any of these three ribotypes gave reports on both past and current treatments. Among them, 50% (9/18) of the subjects were never treated; 33% (6/18) were treated with retinoids; 11% (2/18) were treated with antibiotics in the past, and 5.6% (1/18) were treated with both antibiotics and retinoids in the past. The theory of selection by antibiotic treatment is not favored by this study. Previous surveys of antibiotic resistant strains in acne patients demonstrated that previous use of antibiotics did not always result in the presence of resistant strains and that some patients without previous use of antibiotics harbored resistant strains (Coates et al., 2002; Dreno et al., 2001). Observations in this study are consistent with previous studies.

CRISPR Spacer Sequences

Although more similar to the GC content of *P. acnes* genomes, four unique spacer sequences found in strains of RT2 and RT6 have the best matches to the genome of *Clostridium leptum*, a commensal bacterium in the gut microbiota (Table 2). On the 55 Kb plasmid harbored in HL096PA1 and other RT4 and RT5 genomes, there is also a large cluster of 35 genes that are identical to the genes found in *C. leptum*, including the Tad locus.

Materials and Methods

Metagenomic DNA Extraction, PCR Amplification, Cloning and 16S rDNA Sequencing Metagenomic DNA Extraction Individual microcomedones were isolated from the adhesive nose strip using sterile forceps and placed in a 2 mL sterile microcentrifuge tube filled with ATL buffer (Qiagen) and 0.1 mm diameter glass beads (BioSpec Products, Inc., Bartlesville, Okla.). Cells were lysed using a beadbeater for 3 minutes at 4,800 rpm at room temperature. After centrifugation at 14,000 rpm for 5 minutes, the supernatant was retrieved and used for genomic DNA extraction using QIAamp DNA Micro Kit (Qiagen). The manufacturer protocol for extracting DNA from chewing gum was used. Concentration of the genomic DNA was determined by NanoDrop 1000 Spectrophotometer.

16S rDNA PCR Amplification, Cloning and Sequencing

Most of the metagenomic samples were amplified in triplicate using 16S rDNA specific primers with the following sequences: 27f-MP 5'-AGRGTTTGATCMTG-GCTCAG-3' and 1492r-MP 5'-TACGGYTACCTTGTTAY-GACTT-3'. PCR reactions contained 0.5 U/A Platinum Taq DNA Polymerase High Fidelity (Invitrogen), 1x Pre-mix E PCR buffer from Epicentre Fail-Safe PCR system, 0.12 µM concentration of each primer 27f-MP and 1492r-MP, and Sigma PCR grade water. One microliter of DNA (ranging from 0.2-10 ng total) was added to each reaction. The G-Storm GS4 thermocycler conditions were as following: initial denaturation of 96° C. for 5 minutes, and 30 cycles of denaturation at 94° C. for 30 seconds, annealing at 57° C. for 1 minute, and extension at 72° C. for 2 minutes, with a final extension at 72° C. for 7 minutes. Following amplification, an A-tailing reaction was performed by the addition of 1 U of GOTaq DNA Polymerase directly to the amplification reaction and incubation in the thermocycler at 72° C. for 10 minutes.

The three PCR amplification reactions from each source DNA were pooled and gel purified (1.2% agarose gel stained with SYBR Green fluorescent dye). The 1.4 Kb product was excised and further purified using the Qiagen QIAquick Gel Extraction kit. The purified product was cloned into One-Shot *E. coli* cells using TOPO TA cloning kit from Invitrogen.

White colonies were picked into a 384-well tray containing terrific broth, glycerol, and kanamycin using a Qpix picking robot. Each tray was prepared for sequencing using a magnetic bead prep from Agilent and sequenced with ¹⁄₁₆th Big Dye Terminator from ABI. Sequencing was done with a universal forward, universal reverse, and for a subset, internal 16S rDNA primer 907R with sequences of TGTAAAACGACGGCCAGT (forward), CAGGAAACA-GCTATGACC (reverse), and CCGTCAATTC-CTTTRAGTTT (907R). Sequence reactions were loaded on ABI 3730 machines from ABI on 50 cm arrays with a long read run module.

A slightly different PCR and cloning protocol without automation was used for several initial samples as described below. 16S rDNA was amplified using universal primers 8F (5'-AGAGTTTGATYMTGGCTCAG-3') and 1510R (5'-TACGGYTACCTTGTTACGACTT-3') (Gao et al., 2007). Thermocycling conditions were as following: initial denaturation step of 5 minutes at 94° C., 30 cycles of denaturation at 94° C. for 45 seconds, annealing at 52° C. for 30 seconds and elongation at 72° C. for 90 seconds, and a final elongation step at 72° C. for 20 minutes.

PCR products were purified using DNA Clean and Concentrator Kit (Zymo Research). Subsequently, the 16S rDNA amplicons were cloned into pCR 2.1-TOPO vector (Invitrogen). One-Shot TOP-10 Chemically Competent *E. coli* cells (Invitrogen) were transformed with the vectors and plated on selective media. Individual positive colonies were picked and inoculated into selective LB liquid medium. After 14 hours of incubation, the plasmids were extracted and purified using PrepEase MiniSpin Plasmid Kit (USB Corporation) or Zyppy Plasmid Miniprep Kit (Zymo Research). The clones were sequenced bidirectionally using Sanger sequencing method with ⅛th chemistry using ABI 3730 sequencer (Applied Biosystems Inc.).

*P. acnes* Isolation and Culturing

Sample Culture Plate

Microcomedones on the inner surface of the nose strip were mashed and scraped using a sterile loop (Fisherbrand, Pittsburgh, Pa.), and plated onto a blood agar plate (Teknova Brucella Agar Plate with Hemin and Vitamin K, Teknova, Hollister, Calif.). The plates were incubated at 37° C. for 5-7 days anaerobically using the AnaeroPack System (Mitsubishi Gas Chemical Company, Tokyo, Japan).

Isolation and Culturing of Individual Strains

Colonies with the macroscopic characteristics of *P. acnes* were picked from each sample plate and were streaked onto A-media plates (Pancreatic Digase of Casine, Difco yeast extract, glucose, KH2PO4, MgSO4, Difco Agar, and water). These first-pass plates were then incubated anaerobically at 37° C. for 5-7 days. As the second pass, single isolated colonies were picked from the first-pass plates and streaked onto new A-Media plates. These plates were then incubated anaerobically at 37° C. for 5-7 days. The colonies on these plates were picked for culturing, genotyping, and genome sequencing in the subsequence steps.

Genotyping of the *P. acnes* Isolates

Each isolate was analyzed by PCR amplification of the 16S rDNA gene. The ribotypes were determined based on the full length sequences. Isolates with desired ribotypes were selected for future culturing and genome sequencing.

Genomic DNA Extraction of *P. acnes* Isolates

Isolates were grown in 5 mL of Clostridial medium under anaerobic conditions at 37° C. for 5-7 days. Cultures were pelleted by centrifugation and washed with 3 mL phosphate buffer saline (PBS). The same protocol used for the metagenomic DNA extraction was used for extracting the genomic DNA of the isolates.

Metagenomic Shotgun Sequencing and Analysis

Metagenomic DNA samples from microcomedone samples from 22 individuals with normal skin were pooled and sequenced using Roche/454 FLX. The average read length was 236 bp. The sequencing was limited with 13,291 sequence reads. Sequence reads were aligned against the NCBI's non-redundant database using BLAST. Species assignment was based on 97% identity and 100% of the read length aligned.

Assembly, Alignment and Editing of 16S rDNA Sequences

Assembly and Alignment

Base calling and quality were determined with Phred (Ewing and Green, 1998; Ewing et al., 1998) using default parameters. Bidirectional reads were assembled and aligned to a core set of NAST-formatted sequences (rRNA16S.gold) using AmosCmp16Spipeline and NAST-ier, which are from the Microbiome Utilities Portal of the Broad Institute (microbiomeutil.sourceforge.net/). These tools in turn use Amoscmp (Pop et al., 2004), Mummer (Kurtz et al., 2004), Lucy (Chou and Holmes, 2001), BLAST (Altschul et al., 1990) and CdbTools (compbio.dfci.harvard.edu/tgi/software/). Suspected chimeras were identified using ChimeraSlayer and WigeoN (Haas et al., 2011). Sequences with at least 90% bootstrap support for a chimeric breakpoint (ChimeraSlayer) or containing a region that varies at more than the 99% quantile of expected variation (WigeoN) were removed from further analysis.

Quality Screening

For diversity analysis of the *P. acnes* population, sequences with at least 99% identity over 1,400 nucleotides to *P. acnes* KPA171202 (Bruggemann et al., 2004) 16S rDNA were trimmed to positions 29-1483 (numbering based on the *E. coli* system of nomenclature (Brosius et al., 1978)). Sequences without full coverage over this region were excluded from further strain level analysis. Chimera screening, as described above, resulted in removal of less than 0.35% of the sequences. This may be an under-estimation of the chimeras, since the majority of sequences differ by only 1 or 2 nucleotides. Low quality sequences were excluded, defined as more than 50 nucleotides between positions 79 and 1433 with Phred quality scores of less than 15. To allow detailed strain-level analysis, the data were extensively manually edited. Chromatograms were visually inspected at all bases with a Phred quality score <30, and appropriate corrections were applied. For analysis at the species level, the 16S rDNA sequences were not manually edited. Chimera screening of assembled sequences resulted in removal of less than 0.65% of the sequences. Aligned sequences were trimmed to *E. coli* equivalent positions 29-1483 (Brosius et al., 1978). Sequences without full coverage over this region were excluded from further analysis.

Sequence Editing

Nearly 62,000 Sanger sequence reads representing the 26,446 assembled *P. acnes* sequences were mapped to the RT1 sequence in CONSED (Gordon, 2003; Gordon et al., 1998). Comprehensive semi-manual editing of the large number of sequences was made feasible by their very high pairwise similarities: a median of only one nucleotide change from RT1 per sequence (three nucleotide changes prior to editing). Editing was facilitated by the use of scripts and the custom navigation feature of CONSED allowing single click jumps to sites requiring inspection. Chromatograms were inspected for all low quality (Phred <30) bases that differed from RT1, and corrected as needed, including many commonly occurring sequence errors. In order to minimize the effect of base mis-incorporation and chimera, specific base differences from RT1 occurring in less than 4 sequences (frequency <0.00015) were considered unreliable and reverted to the corresponding RT1 base. Ribotypes were assigned for the resulting sequences based on 100% identity.

16S rDNA Sequence Analysis

OTUs and Taxonomy Assignments

QIIME (Caporaso et al., 2010b) was used to cluster the sequences into OTUs using 99% identity cutoff, furthest neighbor, and UCLUST (Edgar, 2010). Representative sequences (most abundant) were selected and aligned using PYNAST (Caporaso et al., 2010a) to the greengenes database. Taxonomy was assigned using RDP method (Cole et al., 2009). The alignment was filtered with the lanemask provided by greengenes, and a phylogenetic tree was built using FastTree (Price et al., 2009).

Wilcoxon Test on the Top Ten Ribotypes

For each sample, the number of clones of each of the top ten ribotypes was normalized by the total number of *P. acnes* clones of the sample. The normalized counts were used to test the significance in enrichment between the acne group and the normal group. The function wilcox_test in the R program (www.R-project.org) was used to calculate the p-values.

Microbiome Type Assignments

Microbiome types were assigned based on the largest clades seen when samples were clustered using thetayc similarity in MOTHUR (Schloss et al., 2009) (FIGS. 5 and 6) or hierarchical clustering (Eisen et al., 1998) (FIG. 7).

Assigning Ribotypes to Datasets of HMP and Grice et al. 2009

Sequences were assigned to a ribotype if they met the following criteria. First, there was a single best match. Second, it covered the range required to discriminate between the top 45 ribotypes (58-1388). Third, there were no Ns at discriminatory positions. Lastly, there were no more than ten non-discriminatory differences.

The HMP 16S rDNA Sanger sequence dataset was downloaded with permission from the HMP Data Analysis and Coordination Center. It has 8,492 *P. acnes* sequences from 14 subjects and nine body sites (retroauricular crease, anterior nares, hard palate, buccal mucosa, throat, palatine tonsils, antecubital fossa, saliva, and subgingival plaque). More details on the dataset can be found at www.ncbi.nlm-.nih.gov/projects/gap/cgi-bin/study.cgi?study_id=phs000228.v2.p1. In this dataset, low quality bases (Phred quality <20) were converted to Ns, and 26% of the sequences were not assigned due to excessive Ns or Ns at ribotype discriminatory sites. Less than 1% was unresolved due to equal best matches or greater than ten mismatches to RT1.

The dataset from Grice et al. (2009) is available at NCBI (GenBank accession numbers GQ000001 to GQ116391). It has 22,378 *P. acnes* sequences from ten subjects and 21 skin sites (buttock, elbow, hypothenar palm, volar forearm, antecubital fossa, axillary vault, gluteal crease, inguinal crease, interdigital web space, nare, plantar heel, popliteal fossa, toe web space, umbilicus, alar crease, back, external auditory canal, *glabella*, manubrium, occiput, and retroauricular crease). Three percent of the sequences were unassigned due to greater than ten mismatches to RT1, and 1.6% was unassigned due to equal best matches.

For comparison purpose, the unedited 16S rDNA sequences were assigned to ribotypes by the same method described above and the result is shown in FIG. 3. Less than 0.6% of the sequences were unassigned due to greater than ten mismatches to RT1, and 1.7% was unassigned due to equal best matches.

Whole Genome Shotgun Sequencing, Assembly and Annotation of 66 P. acnes Isolates Genome HL096PA1

The genome was sequenced using Roche/454 FLX at the UCLA Genotyping and Sequencing Core. A total of 590,054 sequence reads were generated with an average read length of 230 bp. Of these, 433,896 were assembled into two contigs, a circular main chromosome of 2,494,190 bp and a linear plasmid of 55,585 bp. Assembly was accomplished by a combination of PHRAP/CONSED (Gordon et al., 1998) and GSMAPPER (Roche) with extensive manual editing in CONSED. GeneMark v2.6r (Borodovsky and McIninch, 1993) and GLIMMER v2.0 (Salzberg et al., 1998) were used to performed ab initio protein coding gene prediction. tRNAScan-SE 1.23 was used for tRNA identification and RNAmmer was used for predicting ribosomal RNA genes (5S, 16S, and 23S). Genome annotation results were based on automated searches in public databases, including Pfam (pfam.jouy.inra.fr/), KEGG (www.genome.jp/kegg), and COG (www.ncbi.nlm.nih.gov/COG/). Manual inspection of the annotation was also performed.

Genomes of the Other 65 Isolates

The genomes were sequenced using Illumina/Solexa Genome Analyzer IIx and annotated by the Genome Center of Washington University at St. Louis.

Assembly

Each genomic DNA sample was randomly sheared and an indexed library was constructed using standard Illumina protocols. Twelve uniquely tagged libraries were pooled and run on one lane of a GAIIx flowcell and paired end sequences were generated. Following deconvolution of the tagged reads into the separate samples, datasets were processed using BWA (Li and Durbin, 2009) quality trimming at a q10 threshold. Reads trimmed to less than 35 bp in length were discarded and the remaining reads were assembled using oneButtonVelvet, an optimizer program that runs the Velvet assembler (Zerbino and Birney, 2008) numerous times over a user supplied k-mer range while varying several of the assembler parameters and optimizing for the assembly parameter set which yields the longest N50 contig length.

Annotation

Coding sequences were predicted using GeneMark v3.3 (Borodovsky and McIninch, 1993) and GLIMMER v2.13 (Salzberg et al., 1998). Intergenic regions not spanned by GeneMark and GLIMMER were aligned using BLAST against NCBI's non-redundant database and predictions were generated based on protein alignments. tRNA genes were determined using tRNAscan-SE 1.23 and non-coding RNA genes were determined by RNAmmer-1.2 and Rfam v8.0. The final gene set was processed through a suite of protein categorization tools consisting of Interpro, psort-b and KEGG. The gene product naming comes from the BER pipeline (JCVI). A more detailed standard operating protocol (SOP) can be found at hmpdacc.org/doc/sops/reference_genomes/annotation/WUGC_SOP_DACC.pdf.

71 P. acnes Genome Analysis and Comparison

Identification of the Core Regions of P. acnes Genomes

The "core" regions were defined as genome sequences that are present in all 71 genomes. P. acnes KPA171202 was used as the reference genome. Each of the other 70 genome sequences (a series of contigs in most of the genomes and two complete genomes) was mapped to the reference genome using Nucmer (Kurtz et al., 2004). All the 70 ".coords" output files of Nucmer program were analyzed to identify overlap regions based on the KPA171202 coordinates using a Perl script. Finally, "core" sequences were extracted based on the genome sequence of KPA171202 with the coordinates calculated above. On average, 90% (ranging from 88% to 92%) of the genomes were included in the core regions.

Identification of SNPs in the Core Regions

Single nucleotide polymorphisms (SNPs) were identified by using "show-snps" utility option of the Nucmer program (Kurtz et al., 2004) with the default settings. Genome sequence of P. acnes KPA171202 was used as the reference genome. All the 70 ".snps" output files of Nucmer program were analyzed to identify unique SNP positions based on the KPA171202 coordinates using a Perl script. The SNPs in the core regions were further analyzed to construct a phylogenetic tree.

Phylogenetic Tree Construction

The 71 concatenated sequences of the 96,887 SNP nucleotides in the core regions were used to construct a phylogenetic tree of the P. acnes genomes. The evolutionary distance of the core regions among the genomes was inferred using the Neighbor-Joining method (Saitou and Nei, 1987). The bootstrap tree inferred from 1,000 replicates was taken. Branches corresponding to partitions reproduced in less than 80% bootstrap replicates were collapsed. FIG. 8 shows only the topology. In FIG. 9, the tree was drawn to scale, with branch lengths in the same units as those of the evolutionary distances used to infer the phylogenetic tree. The evolutionary distances were computed using the p-distance method and are in the units of the number of nucleotide differences per site. This tree shows the comparison based on only the core regions. The distance does not represent the true evolutionary distance between different genomes, since the non-core regions of each genome were not considered here. All positions containing gaps and missing data were eliminated. Evolutionary analysis was conducted using MEGA5 (Tamura et al., 2007).

Gene Content Comparison

In order to assess the conservation of gene content across the 71 genomes, protein coding genes in all the genomes were clustered using UCLUST (Edgar, 2010) by first sorting by decreasing length then clustering each sequence to an existing seed sequence if it had at least 90% nucleotide identity over its entire length, otherwise it became a new seed. For visualization, the data were reformatted to columns and rows representing genes and genomes, respectively. One or more copies of the genes in a genome were treated as present. Gene columns were sorted by their position based on the coordinates of the HL096PA1 genome, a fully finished genome with a 55 Kb plasmid. Genome rows were sorted by their positions in the SNP-based Neighbor Joining tree described above.

Identification of CRISPR/Cas

CRISPRFinder (Grissa et al., 2007) was used to identify the CRISPR repeat-spacer sequences. The annotation of HL110PA3 was used for BLAST alignment in order to identify the presence of CRISPR/Cas structure and CRISPR repeat-spacer sequences in strains of HL001PA1, HL060PA1, HL082PA2, HL103PA1, HL106PA1, HL110PA4 and J139. Each spacer sequence was annotated by BLAST alignment against NCBI's non-redundant nucleotide database and the reference genomic sequences database (refseq_genomic).

Sequence Coverage Analysis

MAQ (Li et al., 2008) was used to map the raw sequence reads from Illumina/Roche platform to the reference genomes. Briefly, "map" command was used for mapping, and "assemble" command was used for calling the consensus sequences from read mapping, then "cnd2win" command was used to extract information averaged in a tilling window. A window size of 1,000 bp was used. Randomly selected 1 million reads were used for mapping. This accounted for approximately 40× coverage for all the genomes except HL096PA2, HL096PA3, HL097PA1 and HL099PA1, which had approximately 55× to 75× coverage. BWA (Li and Durbin, 2010) was used to map the raw sequence reads from Roche/454 platform to the reference genome HL096PA1. The average coverage was calculated in 1,000 by window.

Quantitative PCR

Quantitative PCR (qPCR) targeting TadA on the plasmid (Locus 3) and housekeeping genes Pak and RecA on the chromosome was performed using the genomic DNA extracted from the *P. acnes* isolates. LightCyler 480 High Resolution Melting Master kit was used (Roche Diagnostics GmbH, Mannheim, Germany). Each 10 μL reaction solution was consisted of 5 μL master mix (2× concentrate), 1 μL 25 mM MgCl2, 0.5 μL 4 μM forward and reverse primers, and DNA template. Four qPCR runs were performed on Roche LightCycler 480. Primer sequences for TadA are 5'-GA-TAATCCGTTCGACAAGCTG-3' (forward) and 5'-AC-CCACCACGATGATGTTT-3' (reverse). Primer sequences for pak are 5'-CGACGCCTCCAATAACTTCC-3' (forward) and 5'-GTCGGCCTCCTCAGCATC-3' (reverse). Primer sequences for recA are 5'-CCGGAGACAACGACAGGT-3' (forward) and 5'-GCTTCCTCATACCACTGGTCATC-3' (reverse). All samples were run in duplicates in each qPCR run, except the second run, which was not duplicated. Thermocycling conditions were as following: initial activation step of 10 minutes at 95° C.; 50 amplification cycles with each consisting of 10 seconds at 95° C., 15 seconds at 65° C. in the first cycle with a stepwise 0.5° C. decrease for each succeeding cycle, and 30 seconds at 72° C.; and final melting curve step starting at 65° C. and ending at 99° C. with a ramp rate of 0.02° C./s and acquisition rate of 25/° C. DNA concentration standards were run in duplicates. Copy number ratios of genes were calculated based on the concentrations of the genes on the plasmid and chromosome.

Data Availability 16S rDNA sequences have been deposited at GenBank under the project ID 46327. Whole genome shotgun sequences and annotations of the *P. acnes* strains have been deposited at GenBank under the accession numbers ADWB00000000, ADWC00000000, ADWF00000000, ADW H00000000, ADWI00000000, ADXP00000000, ADXQ00000000, ADXR00000000, ADXS00000000, ADXT00000000, ADXU00000000, ADXW00000000, ADXX00000000, ADXY00000000, ADXZ00000000, ADYA00000000, ADYB00000000, ADYC00000000, ADYD00000000, ADYE00000000, ADYF00000000, ADYG00000000, ADYI00000000, ADYJ00000000, ADYK00000000, ADYL00000000, ADYM00000000, ADYN00000000, ADYO00000000, ADYP00000000, ADYQ00000000, ADYR00000000, ADYS00000000, ADYT00000000, ADYU00000000, ADYV00000000, ADYW00000000, ADYX00000000, ADYY00000000, ADYZ00000000, ADZA00000000, ADZB00000000, ADZC00000000, ADZD00000000, ADZE00000000, ADZF00000000, ADZG00000000, ADZH00000000, ADZI00000000, ADZJ00000000, ADZK00000000, ADZL00000000, ADZM00000000, ADZN00000000, ADZO00000000, ADZP00000000, ADZQ00000000, ADZR00000000, ADZS00000000, ADZT00000000, ADZV00000000, ADZW00000000, CP003293, and CP003294.

Example 2—Pan-Genome and Comparative Genome Analysis of *Propionibacterium Acnes*

*Propionibacterium acnes* is a major human skin bacterium. To understand whether different strains have different virulent properties and thus play different roles in health and diseases, the genomes of 82 *P. acnes* strains, most of which were isolated from acne or healthy skin, were compared. Lineage-specific genetic elements were identified that may explain the phenotypic and functional differences of *P. acnes* as a commensal in health and as a pathogen in diseases. By analyzing a large number of sequenced strains, an improved understanding of the genetic landscape and diversity of the organism at the strain level and at the molecular level is provided.

Introduction

*Propionibacterium acnes* is a major commensal of the human skin. It contributes to maintaining the skin health by inhibiting the invasion of common pathogens, such as *Staphylococcus aureus* and *Streptococcus pyogenes*. It does so by hydrolyzing triglycerides and releasing free fatty acid that contributes to the acidic pH of the skin surface (1). On the other hand, *P. acnes* has been historically linked to acne vulgaris, a chronic inflammatory disease of the pilosebaceous unit affecting more than 85% of adolescents and young adults (2). A metagenomic study previously demonstrated that *P. acnes* was a dominant bacterium in the pilosebaceous unit in both healthy individuals and acne patients (3, 4). At the strain level, however, the population structures of *P. acnes* were different between the two groups. These findings suggested that microbe-related human diseases are often caused by certain strains of a species rather than the entire species, in line with the studies of other diseases (5, 6).

*P. acnes* has been classified into three distinct types. Studies by Johnson and Cummins (7) first revealed two distinct phenotypes of *P. acnes*, known as types I and II, that could be distinguished based on serological agglutination tests and cell wall sugar analysis. McDowell et al. (8) differentiated types I and II *P. acnes* by monoclonal antibody typing. Furthermore, their phylogenetic analysis of *P. acnes* strains based on the nucleotide sequences of the recA gene and a more variable hemolysin/cytotoxin gene (tly) demonstrated that types I and II represent distinct lineages. Their investigations also revealed that strains within the type I lineage could be further split into two clades, known as types IA and IB (8, 9). An additional phylogenetic group of *P. acnes*, known as type III was described later (10). Recent studies based on multilocus sequence typing (MLST) further sub-divided *P. acnes* into closely related clusters, some of which were associated with various diseases including acne (11-13).

The first complete genome sequence of *P. acnes*, KPA171202, a type IB strain, provided insights on the pathogenic potential of this Gram-positive bacterium (14). The genome is 2.56 M bp with 60% of GC content. It encodes 2,333 open reading frames (ORFs) including multiple gene products involved in degrading host molecules, such as sialidases, neuraminidases, endoglycoceramidases, lipases, and pore-forming factors. However, the sequence of a single genome does not reflect the genetic landscape of the organism and how genetic variations among strains determine their various phenotypes and pathogenic properties.

To better understand the human microbiome variations at the strain level, as part of the Human Microbiome project (HMP) (15, 16), previously generated were the reference genome sequences of 66 *P. acnes* strains selected from a collection of over 1,000 strains isolated from a cohort of healthy subjects and acne patients (4). These 66 strains represent the major lineages of *P. acnes* found on the human skin, including types IA, IB, and II. To cover all the main *P. acnes* lineages in the analysis, three additional *P. acnes* strains were sequenced, including the first available type III *P. acnes* genome. Thirteen *P. acnes* genomes sequenced by other research groups (14, 17-22) were also available at the time of analysis. With a total of 82 genomes, performed was a comparative genome analysis to characterize the pan-genome of *P. acnes*, the phylogenetic relationships among different lineages, the microevolution of the strains in the same individual microbiome, and the genetic elements specific to each lineage and their associations with health and disease.

Results

*P. acnes* Strains and General Genome Features

To understand the genomic diversity of this important skin commensal at the strain level, the genomes of 69 sequenced *P. acnes* strains were analyzed. Among them, 67 *P. acnes* strains were isolated from the skin of healthy individuals and acne patients (3, 4), and two *P. acnes* strains, HL201 PA1 and HL202PA1, were isolated from refractory endodontic lesions (23) (Table 2-1).

TABLE 2-1

General features of the 82 *P. acnes* genomes

| Genome | Strain name | Origin | Ribotype | recA type | Sequencing method | Genome size (Mb) | GC % | Number of ORFs |
|---|---|---|---|---|---|---|---|---|
| 1 | HL001PA1 | Skin | 2 | II | Illumina | 2.49 | 60.0 | 2,661 |
| 2 | HL002PA1 | Skin | 3 | IB | Illumina | 2.48 | 60.1 | 2,549 |
| 3 | HL002PA2 | Skin | 1 | IA | Illumina | 2.48 | 60.1 | 2,594 |
| 4 | HL002PA3 | Skin | 1 | IA | Illumina | 2.48 | 60.1 | 2,565 |
| 5 | HL005PA1 | Skin | 4 | IA | Illumina | 2.53 | 60.2 | 2,724 |
| 6 | HL005PA2 | Skin | 1 | IA | Illumina | 2.48 | 60.0 | 2,645 |
| 7 | HL005PA3 | Skin | 1 | IA | Illumina | 2.48 | 60.1 | 2,579 |
| 8 | HL005PA4 | Skin | 3 | IB | Illumina | 2.47 | 60.0 | 2,607 |
| 9 | HL007PA1 | Skin | 4 | IA | Illumina | 2.53 | 60.2 | 2,691 |
| 10 | HL013PA1 | Skin | 3 | IB | Illumina | 2.48 | 60.0 | 2,618 |
| 11 | HL013PA2 | Skin | 1 | IA | Illumina | 2.48 | 60.1 | 2,588 |
| 12 | HL020PA1 | Skin | 1 | IA | Illumina | 2.48 | 60.1 | 2,554 |
| 13 | HL025PA1 | Skin | 1 | IB | Illumina | 2.54 | 60.1 | 2,581 |
| 14 | HL025PA2 | Skin | 3 | IB | Illumina | 2.48 | 60.0 | 2,616 |
| 15 | HL027PA1 | Skin | 3 | IB | Illumina | 2.53 | 60.1 | 2,711 |
| 16 | HL027PA2 | Skin | 1 | IA | Illumina | 2.48 | 60.1 | 2,629 |
| 17 | HL030PA1 | Skin | 1 | IB | Illumina | 2.54 | 60.0 | 2,662 |
| 18 | HL030PA2 | Skin | 3 | IB | Illumina | 2.51 | 60.1 | 2,647 |
| 19 | HL036PA1 | Skin | 532 | IA | Illumina | 2.48 | 60.1 | 2,575 |
| 20 | HL036PA2 | Skin | 532 | IA | Illumina | 2.48 | 60.1 | 2,565 |
| 21 | HL036PA3 | Skin | 1 | IA | Illumina | 2.48 | 60.1 | 2,601 |
| 22 | HL037PA1 | Skin | 3 | IB | Illumina | 2.48 | 60.1 | 2,617 |
| 23 | HL038PA1 | Skin | 4 | IA | Illumina | 2.54 | 60.2 | 2,663 |
| 24 | HL042PA3 | Skin | 6 | II | Roche/454 | 2.53 | 60.1 | 2,610 |
| 25 | HL043PA1 | Skin | 5 | IA | Illumina | 2.53 | 60.2 | 2,698 |
| 26 | HL043PA2 | Skin | 5 | IA | Illumina | 2.53 | 60.2 | 2,688 |
| 27 | HL045PA1 | Skin | 4 | IA | Illumina | 2.53 | 60.2 | 2,692 |
| 28 | HL046PA1 | Skin | 3 | IB | Illumina | 2.48 | 60.0 | 2,599 |
| 29 | HL046PA2 | Skin | 1 | IA | Illumina | 2.53 | 60.1 | 2,692 |
| 30 | HL050PA1 | Skin | 3 | IB | Illumina | 2.48 | 60.0 | 2,652 |
| 31 | HL050PA2 | Skin | 1 | II | Illumina | 2.46 | 60.1 | 2,581 |
| 32 | HL050PA3 | Skin | 3 | IB | Illumina | 2.48 | 60.0 | 2,558 |
| 33 | HL053PA1 | Skin | 4 | IA | Illumina | 2.53 | 60.2 | 2,632 |
| 34 | HL053PA2 | Skin | 8 | IB | Illumina | 2.51 | 60.1 | 2,664 |
| 35 | HL056PA1 | Skin | 4 | IA | Illumina | 2.48 | 60.1 | 2,581 |
| 36 | HL059PA1 | Skin | 16 | IB | Illumina | 2.48 | 60.1 | 2,570 |
| 37 | HL059PA2 | Skin | 16 | IB | Illumina | 2.48 | 60.0 | 2,535 |
| 38 | HL060PA1 | Skin | 2 | II | Illumina | 2.48 | 60.1 | 2,601 |
| 39 | HL063PA1 | Skin | 1 | IA | Illumina | 2.48 | 60.1 | 2,520 |
| 40 | HL063PA2 | Skin | 3 | IB | Illumina | 2.53 | 60.0 | 2,669 |
| 41 | HL067PA1 | Skin | 3 | IB | Illumina | 2.53 | 60.1 | 2,633 |
| 42 | HL072PA1 | Skin | 5 | IA | Illumina | 2.53 | 60.1 | 2,594 |
| 43 | HL072PA2 | Skin | 5 | IA | Illumina | 2.53 | 60.1 | 2,672 |
| 44 | HL074PA1 | Skin | 4 | IA | Illumina | 2.53 | 60.2 | 2,723 |
| 45 | HL078PA1 | Skin | 1 | IA | Illumina | 2.58 | 60.1 | 2,785 |
| 46 | HL082PA1 | Skin | 8 | IB | Illumina | 2.50 | 60.1 | 2,648 |
| 47 | HL082PA2 | Skin | 2 | II | Illumina | 2.51 | 60.0 | 2,644 |
| 48 | HL083PA1 | Skin | 1 | IA | Illumina | 2.48 | 60.1 | 2,575 |
| 49 | HL083PA2 | Skin | 3 | IB | Illumina | 2.48 | 60.0 | 2,633 |
| 50 | HL086PA1 | Skin | 8 | IB | Illumina | 2.53 | 60.1 | 2,610 |
| 51 | HL087PA1 | Skin | 3 | IB | Illumina | 2.48 | 60.1 | 2,584 |
| 52 | HL087PA2 | Skin | 1 | IA | Illumina | 2.48 | 60.1 | 2,572 |
| 53 | HL087PA3 | Skin | 3 | IB | Illumina | 2.52 | 60.1 | 2,619 |
| 54 | HL092PA1 | Skin | 8 | IB | Illumina | 2.50 | 60.1 | 2,590 |
| 55 | HL096PA1 | Skin | 5 | IA | Roche/454 | 2.49 | 60.0 | 2,393 |
| 56 | HL096PA2 | Skin | 5 | IA | Illumina | 2.56 | 60.1 | 2,638 |
| 57 | HL096PA3 | Skin | 1 | IA | Illumina | 2.56 | 60.0 | 2,651 |
| 58 | HL097PA1 | Skin | 5 | IC | Illumina | 2.52 | 60.2 | 2,617 |

TABLE 2-1-continued

General features of the 82 P. acnes genomes

| Genome | Strain name | Origin | Ribotype | recA type | Sequencing method | Genome size (Mb) | GC % | Number of ORFs |
|---|---|---|---|---|---|---|---|---|
| 59 | HL099PA1 | Skin | 4 | IA | Illumina | 2.58 | 60.1 | 2,735 |
| 60 | HL100PA1 | Skin | 1 | IA | Illumina | 2.48 | 60.1 | 2,562 |
| 61 | HL103PA1 | Skin | 2 | II | Illumina | 2.48 | 60.1 | 2,546 |
| 62 | HL106PA1 | Skin | 2 | II | Illumina | 2.48 | 60.1 | 2,533 |
| 63 | HL106PA2 | Skin | 1 | IA | Illumina | 2.48 | 60.1 | 2,567 |
| 64 | HL110PA1 | Skin | 8 | IB | Illumina | 2.51 | 60.1 | 2,667 |
| 65 | HL110PA2 | Skin | 8 | IB | Illumina | 2.50 | 60.1 | 2,614 |
| 66 | HL110PA3 | Skin | 6 | II | Illumina | 2.54 | 60.1 | 2,806 |
| 67 | HL110PA4 | Skin | 6 | II | Illumina | 2.54 | 60.1 | 2,724 |
| 68 | HL201PA1 | Refractory endodontic lesion | 6 | III | Illumina | 2.48 | 60.1 | 2,629 |
| 69 | HL202PA1 | Refractory endodontic lesion | Not assigned | II | Illumina | 2.56 | 60.0 | 2,821 |
| 70 | KPA171202 | Plate | 1 | IB | Sanger | 2.56 | 60.0 | 2,297 |
| 71 | J139 | Skin | 2 | II | Roche/454 | 2.48 | 60.0 | 2,364 |
| 72 | J165 | Skin | 1 | IA | Roche/454 | 2.50 | 60.0 | 2,403 |
| 73 | SK137 | Skin | 1 | IA | Roche/454 | 2.50 | 60.0 | 2,352 |
| 74 | SK187 | Skin | 3 | IB | Roche/454 | 2.51 | 59.0 | 2,381 |
| 75 | SK182 | Skin | 1 | IA | Roche/454 | 2.48 | 60.0 | 2,338 |
| 76 | 266 | Pleuropulmonary Infection | 1 | IA | Roche/454 | 2.50 | 60.0 | 2,412 |
| 77 | 6609 | Skin | 1 | IB | Solid | 2.56 | 60.0 | 2,358 |
| 78 | ATCC11828 | Abscess | 2 | II | Solid | 2.49 | 60.0 | 2,260 |
| 79 | P.acn17 | Corneal scrape | 3 | IB | Solid | 2.62 | 60.0 | 2,266 |
| 80 | P.acn31 | Aqueous humour | 3 | IB | Solid | 2.50 | 60.0 | 2,247 |
| 81 | P.acn33 | Aqueous humour | 3 | IB | Solid | 2.49 | 60.0 | 2,236 |
| 82 | PRP-38 | Skin | 5 | IC | Solid | 2.51 | 60.0 | 2,233 |

These 69 strains cover all the known P. acnes lineages isolated to date. The strains were classified based on their 16S ribosomal RNA (rRNA) sequences. Each unique 16S rRNA sequence was defined as a ribotype (RT). All the sequenced P. acnes genomes had three identical copies of 16S rRNA. Based on the metagenomic study of the skin microbiome associated with acne (4), among the top ten major ribotypes, RT1, RT2, and RT3 were the most abundant and found in both healthy individuals and acne patients with no significant differences. RT4, RT5, and RT8, however, were enriched in acne patients, while RT6 was mostly found in healthy individuals. The 69 strains included 19 RT1 strains, five RT2 strains, 15 RT3 strains, eight RT4 strains, seven RT5 strains, four RT6 strains, six RT8 strains, four strains of minor ribotypes, and one type III strain. The average genome size was 2.50 Mb (ranging from 2.46 to 2.58 Mb) and the GC content was 60%. On average, each genome encoded 2,626 ORFs (ranging from 2,393 to 2,806) (Table 2-1).

The analysis included 13 additional P. acnes genomes that were publicly available (14,17-22) (Table 2-1). The average genome size of these 13 P. acnes strains was 2.51 Mb (ranging from 2.48 to 2.56 Mb) and the GC content was 60%, encoding 2,319 ORFs on average (ranging from 2,233 to 2,412). These 13 genomes include six RT1 strains, two RT2 strains, four RT3 strains, and one RT5 strain, however, no genomes of RT4, RT6, RT8 and type III strains were available. The sequencing effort significantly increased the number of genomes for each P. acnes lineage as well as the number of lineages covered.

P. acnes Pan-Genome

Figure 13:
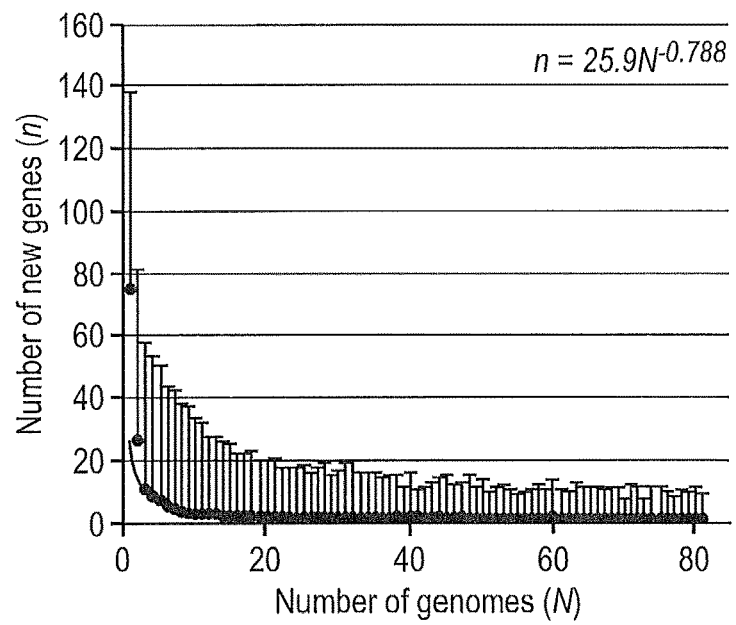
FIG. 13 shows a power law regression for new genes (n) discovered with the addition of new genome sequences (N). Circles are the medians of n for 200 simulations. Error bars indicate the standard deviations for the 200 simulations.
Figure 14:
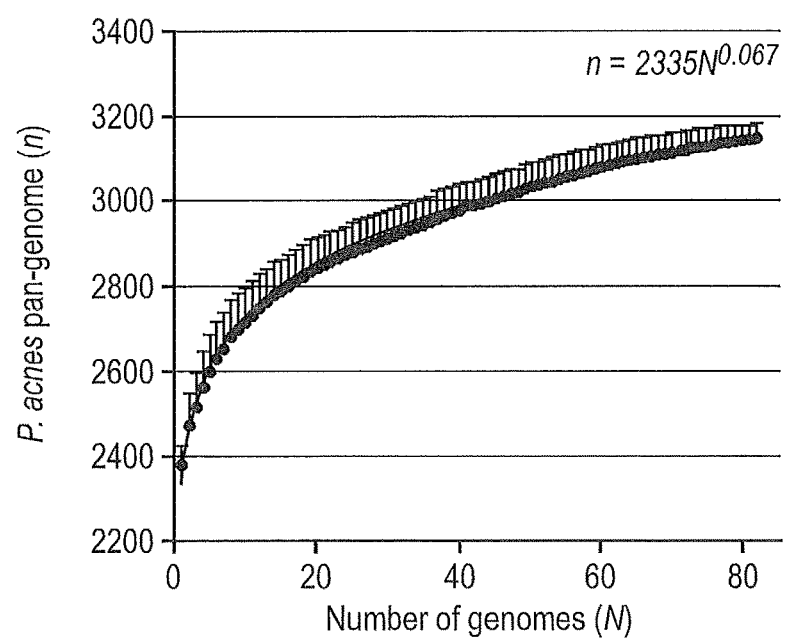
FIG. 14 shows a power law regression for total genes (n) accumulated with the addition of new genome sequences (N). Circles are the medians of n for 200 simulations. Error bars indicate the standard deviations for the 200 simulations.

To determine the genetic landscape of P. acnes, the pan-genome based on the 82 P. acnes genomes was estimated. The number of new genes that would be discovered by sequencing additional P. acnes genomes by using a power law regression analysis, $n=\kappa N^\gamma$ (24), was estimated (FIG. 13). The analysis identified that $\alpha$ was 0.788. The average number of new genes added by a novel genome was three when the 82nd genome was added. The number of P. acnes pan-genes that would be accumulated by sequencing additional P. acnes genomes by using a power law regression analysis, $n=\kappa N^\gamma$, was then estimated (FIG. 14). The exponent $\gamma$ was 0.067, and P. acnes had 3,136 pan-genes (N=82). Based on these results, the pan-genome of P. acnes is defined as open, as the exponent $\alpha$ was less than one and $\gamma$ was greater than zero (24). However, since $\alpha$ was close to one and $\gamma$ was close to zero, it is believed that this organism evolved tightly without large expansions.

Phylogenetic Relationships Among the P. acnes Genomes

Figure 15:
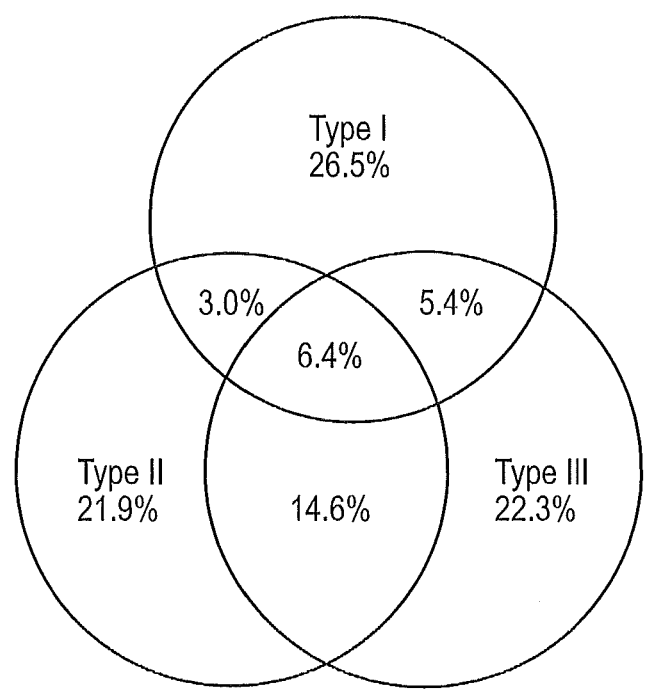
FIG. 15 shows the proportion of the 123,223 SNPs in the core regions specific to recA types I, II and III.
Figure 16:
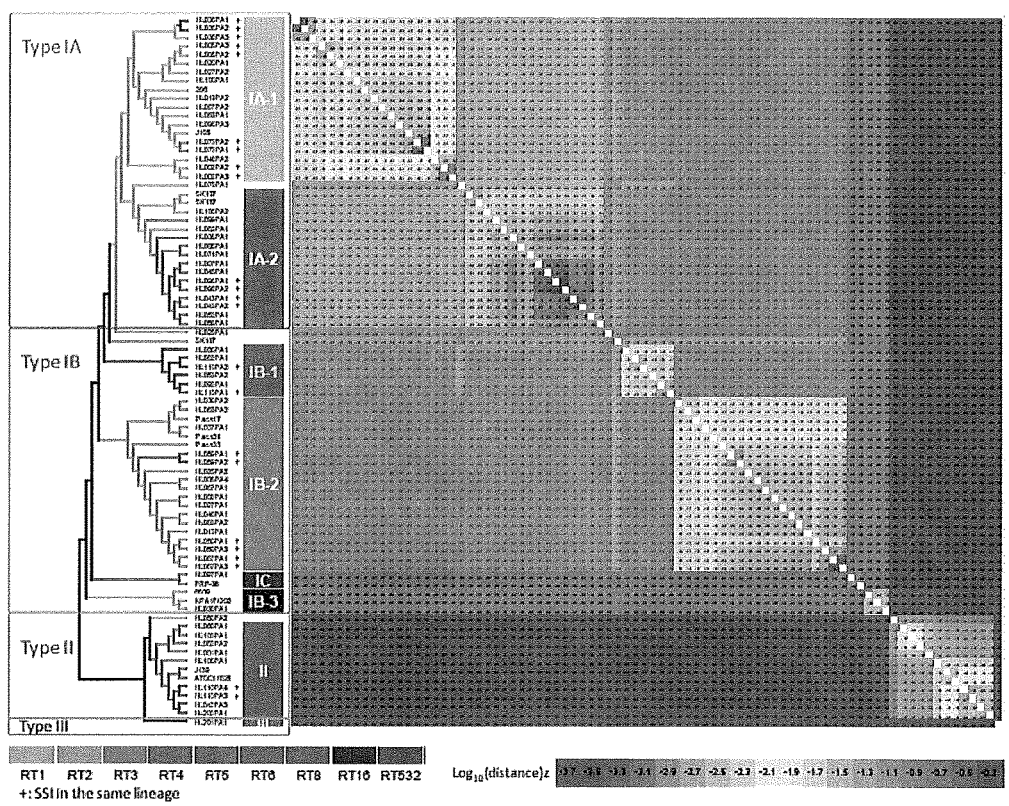
FIG. 16 shows the phylogenetic tree of 82 *P. acnes* strains constructed based on the 123,223 SNPs in the core regions (2.20 Mb). The distances between strains were calculated as nucleotide substitution rates at all SNP sites, colored according to the scale bar. The strains from the same individuals (SSIs) belonging to the same lineages were marked with "+".

A genome comparison of the 82 P. acnes strains revealed that 2.20 Mb (88% of the average genome) was shared by all the P. acnes genomes, which are referred to herein as the "core regions." Within the core regions, 123,223 unique single nucleotide polymorphisms (SNPs) were detected among the strains. Twenty seven percent of the SNPs were unique to type I, 22% were unique to type II, and 22% were unique to type III (FIG. 15). A phylogenetic tree based on the 123,223 SNPs in the core regions was constructed (FIG. 16). The tree showed that the recA type classification of the strains was consistent with the major clades based on the genomes. The recA type IA, IB, and II strains were all clustered together within each type, respectively, except HL097PA1 and PRP-38. The only recA type III strain, HL201 PA1, formed a separate branch from type I and type II strains. The tree also showed that the 16S rRNA ribotypes of the strains were consistent with the phylogenetic relationships inferred from the genome sequences. Most of the RT1 strains were clustered in clade IA-1, while all the RT4 and most of the RT5 strains were clustered in clade IA-2. All six RT8 strains were clustered together in clade IB-1. All the RT3 and RT16 strains were clustered together in clade IB-2 except SK187. HL030PA1 and KPA171202 were clustered together with 6609, as a distinct IB-3 clade. HL097PA1 and PRP-38 were clustered together and were classified as a novel type IC recently named by McDowell et al. (22). All the RT2 strains were clustered in clade II, distant from clade I, together with RT6 strains. HL202PA1, which is a RT6 strain and was isolated from an oral site, was not much different from the skin RT6 isolates and was clustered together. The sequence types of all the strains were assigned based on two published MLST schemes (11,13) and are shown in Table 51. The phylogenetic tree based on the core genome regions demonstrated that 16S ribotyping can be used for *P. acnes* strain identification and classification. It provides a much higher resolution than recA typing, and in the meantime, it is much simpler and faster with only one gene required than MLST, which is a laborious process generally requiring 7-9 genes.

Figure 17A:
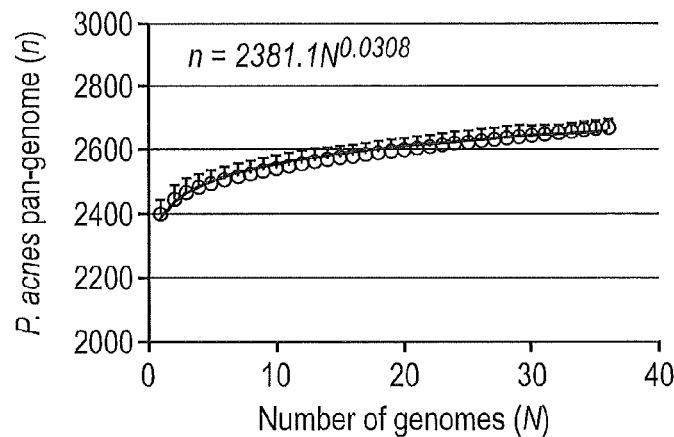
FIG. 17 shows the pan-genomes of types IA (A), IB (B) and II (C) strains. Circles are the medians of n for 200 simulations. Error bars are standard deviations for the 200 simulations.
Figure 17B:
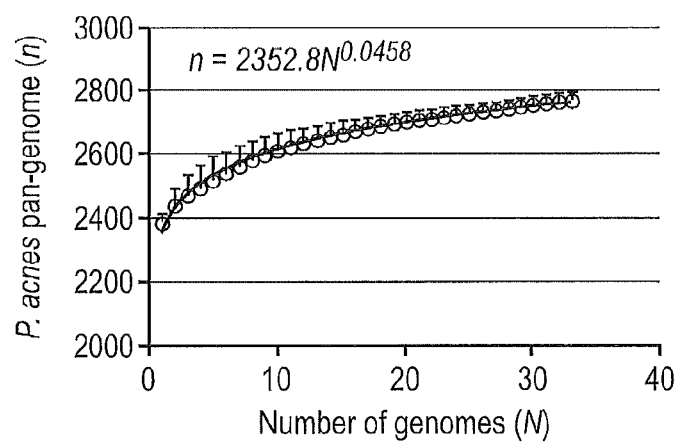
Figure 17C:
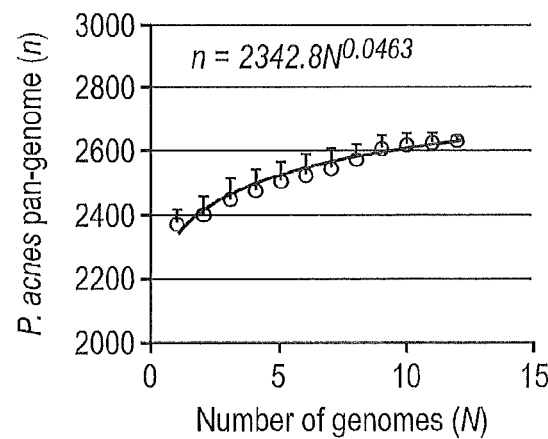

The large number of genome sequences that were generated permitted analyzing the *P. acnes* pan-genome at the clade level. Clades IA, IB and II had 36, 33 and 12 genomes, respectively. Based on the power law regression analyses described above, it was determined that at the clade level *P. acnes* also has an open pan-genome for recA type IA clade, type IB clade and type II clade with limited expansions (FIG. 17). The expansion rates were not significantly different among the clades and were similar to the one at the species level. This suggests that all the major lineages of *P. acnes* had evolved at a similar rate.

SNP Distribution in the Core Genome Regions

Figure 18:
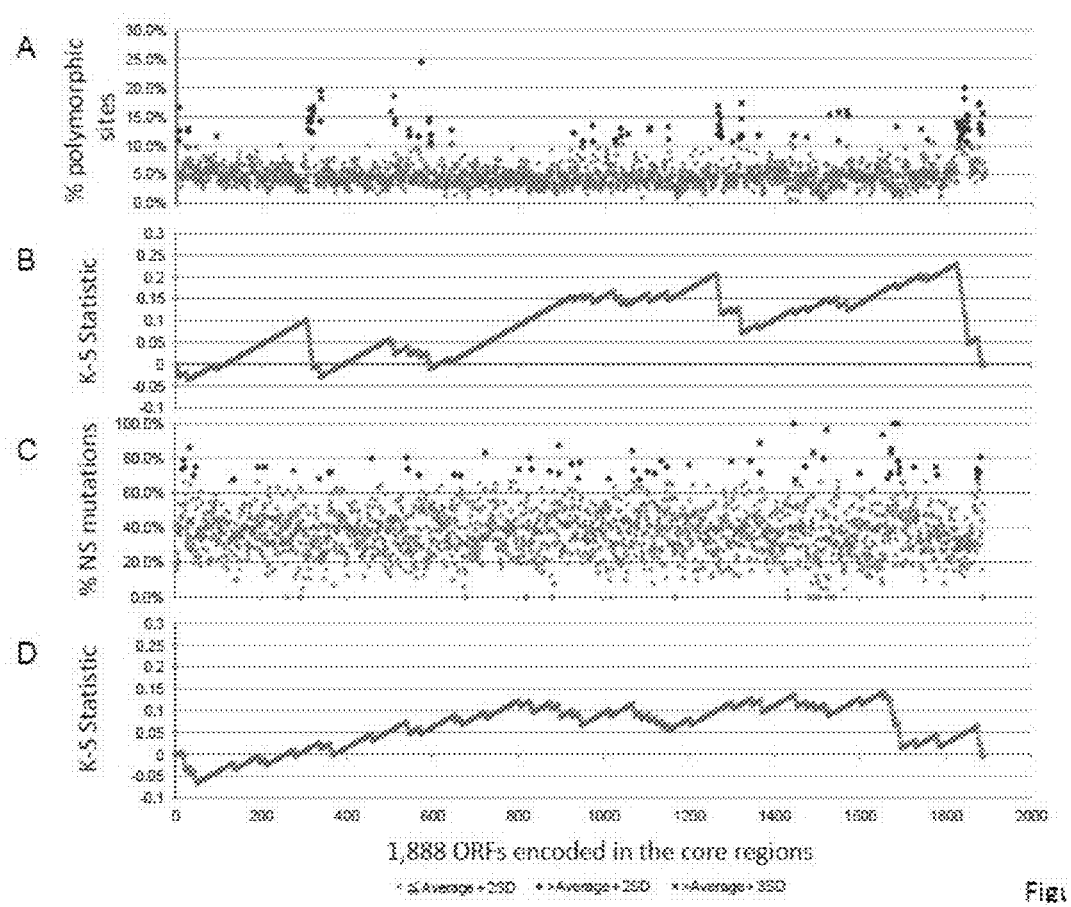
FIG. 18 shows the SNP distribution in core regions. (A) shows SNP frequencies (percentage of polymorphic sites) of the genes in the core regions. (B) provides K-S statistics for genes that had higher SNP frequencies with more than two standard deviations (SD). (C) reflects non-synonymous mutation frequencies of the genes in the core regions. (D) provides K-S statistics for genes that had higher non-synonymous mutation frequencies with more than 2 standard deviations.

To understand whether there are "hot spots" for mutation and/or recombination in the *P. acnes* genomes, it was determined whether the SNPs were randomly distributed throughout the genomes or were enriched in particular regions. The frequency of SNPs in each protein coding gene in the core regions was calculated. The average rate of polymorphic sites in the core regions was 5.3%, i.e., 5.3 unique SNPs in every 100 bp. This rate is comparable to the ones found in multiple gut bacterial genomes (25). Among the 1,888 genes encoded in the core regions, 55 genes had higher SNP frequencies with more than two standard deviations (SD), and 47 genes with more than three SD (FIG. 18) (A). Using the Kolmogorov-Smirnov (K-S) test, it was demonstrated that these 102 highly mutated genes were not randomly distributed throughout the genome (P<0.01) (FIG. 18) (B). This suggests that *P. acnes* has an evolutionary risk management strategy. Based on the Clusters of Orthologous Groups (COG) categories, the functions of these 102 genes showed a similar distribution as those of all 1,888 genes in the core regions. There was no enrichment of a particular functional category in these frequently mutated genes.

It was further determined whether the mutations in the core regions were under selection by calculating the ratio of non-synonymous (NS) vs. synonymous (S) SNPs for the 1,888 genes. The average rate of NS mutations was 38%. Among the 1,888 genes, 54 genes had higher NS mutation rates with more than two SD and 13 genes with more than three SD (FIG. 18)(C). These 67 genes were randomly distributed in the genome and not particularly enriched in certain regions (P>0.05 with the K-S test) (FIG. 18)(D). Most of the 102 genes with higher SNP frequencies did not overlap with these 67 genes, suggesting that independent evolutionary events might lead to these gene alternations. Only ten genes had both high SNP frequencies and high NS mutation rates, all annotated as hypothetical proteins.

Evolutionary Relationships of the Strains Isolated from the Same Individuals

The large number of *P. acnes* strains isolated from the cohort of acne patients and healthy individuals allowed the investigation of whether the *P. acnes* strains in hair follicles from the same individual were clonal. Based on previous metagenomic analysis, it was demonstrated that most individuals harbored multiple *P. acnes* strains from different lineages (4). However, it was not known whether the strains of the same lineage in the same individual were derived from the same ancestor. Genome sequences of the strains isolated from the same samples makes it possible to examine whether the Strains from the Same Individuals (SSIs) evolved from the same origin via clonal expansion. The 69 sequenced *P. acnes* strains included 49 SSIs: 13 duets (i.e., 13 pairs of strains isolated from 13 individuals), five trios, and two quartets. Twenty three SSIs were clustered in the same clades, nine in clade IA-1, four in clade IA-2, two in clade IB-1, six in clade IB-2 and two in clade II. The distance (substitution rate at the 123,223 SNP sites in the core regions) between each pair of SSIs was calculated (FIG. 16). The average distance of the SSIs in clade IA-1 was 0.0014, while that of strains from different individuals in clade IA-1 was 0.0064 (P<0.001). Consistent results were observed in other clades including IA-2, IB-1, IB-2, and II (FIG. 19)(A). This demonstrated that the SSIs in the same lineage were significantly more similar to each other than the strains isolated from different individuals, suggesting that they were clonal in each individual. Among the RT4 and RT5 strains within clade IA-2, however, the average distance between SSIs (0.0004) was not significantly different from the average distance between strains from different individuals (0.0017) (P=0.072). Moreover, the average distance between RT4/RT5 strains from different individuals (0.0017) was similar to the average distance between the SSIs in clade IA-1 (0.0014), and even shorter than the average distances between the SSIs in clades IB-1 (0.0059), IB-2 (0.0019) and II (0.0022) (Fig. S3A). This suggests that although isolated from different individuals, these RT4 and RT5 strains seemed to be clonal and had evolved from the same recent ancestor. A similar relationship between the two RT5 strains in clade IC were observed, where HL097PA1 and PRP-38, isolated from different individuals, were closely related to each other with a distance of 0.0012. The metagenomic study has demonstrated a strong association of strains of RT4 and RT5 with acne (4). The clonality of these strains isolated from different individuals suggests that RT4 and RT5 strains may be transmitted among individuals. This finding is consistent with the previous clinical report that antibiotic-resistant Propionibacteria were transmissible between acne-prone individuals including dermatologists (26), as most of the antibiotic-resistant *P. acnes* strains belong to RT4 and RT5 (4,13). The analysis of SSIs further supports the theory that RT4 and RT5 strains may be a pathogenic factor in acne.

To determine whether the distances between strain pairs from the same individuals but belonging to different lineages were different from random strain pairs, the distances of any pair of SSIs from different clades were calculated. The average distance of the SSIs between clades IA-1 and IA-2 (i.e., HL005PA3 vs. HL005PA1, HL005PA2 vs. HL005PA1, HL096PA3 vs. HL096PA1, and HL096PA3 vs. HL096PA2) was 0.039, similar to that of the isolates from different individuals (0.040). Similar results were obtained for all other clade pair comparisons (FIG. 19)(B). These results demonstrated that the SSIs from different clades were similarly different from each other as to the strains from different individuals. This analysis suggests that in each individual microbiome *P. acnes* strains undergo clonal expansion in the same population, while multiple strain populations can often co-exist in the same community with little recombination.

Non-Core Genome Regions in Type I Strains

By comparing the genome sequences of the 82 *P. acnes* strains, non-core genome regions were identified that were not shared by all 82 strains. The total length of the non-core regions was approximately 0.90 Mb. The average GC content of the non-core regions was slightly lower than that of the core regions, 58%±6.9%, suggesting that part of the non-core regions might be originated from other species via horizontal gene transfer.

Figure 20:
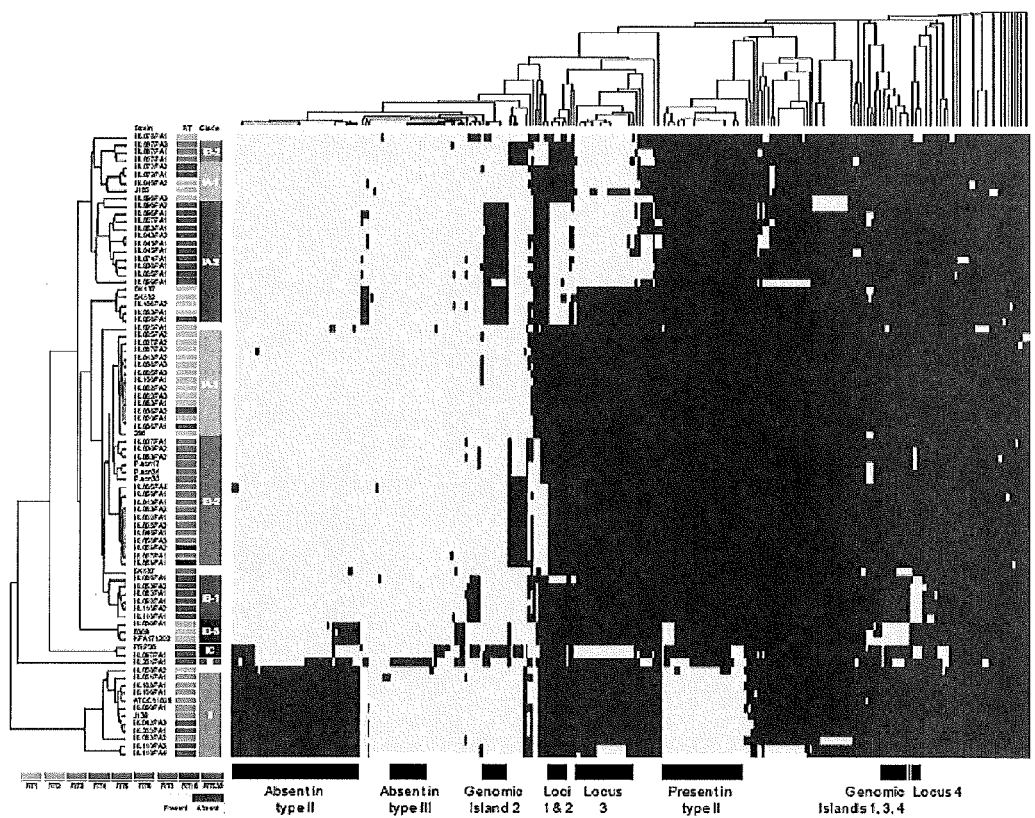
FIG. 20 reflects that *P. acnes* strains within each lineage share unique non-core genomic regions. Rows represent 82 *P. acnes* genomes and columns represent 314 non-core regions that are longer than 500 bp. The genomes and the non-core regions were clustered based on similarity, respectively. The width of each block plotted is not proportional to the genomic length of each non-core region. The presence of a non-core region is colored in yellow, and the absence is colored in blue. The color schemes used for RT and clades are the same as in FIG. 16.

Different lineages of *P. acnes* strains have distinct non-core regions. Using hierarchical clustering of the non-core regions, it was shown that the strains of the same ribotypes were clustered together with distinct separations among the clades (FIG. 20). Among the non-core regions, the genetic elements specific to each lineage were identified, which may explain the phenotypic and functional differences of the strains in health and disease. In clade IA-2, genomic loci 1, 2 and 3 were identified, which were unique to mainly the RT4 and RT5 strains (4). These loci appear to be originated from mobile elements, encode several virulent genes, and may contribute to the virulence of these strains. In the meantime, the genomic island-like cluster 2 (GI2) (18) was uniquely absent in most of the strains in this clade. Clade IB-1 consisted of all RT8 strains, which were also highly associated with acne based on our metagenomic study (4). They all have a unique genomic island (locus 4), which is 20 Kb long and encodes a series of nonribosomal peptide synthetases (NRPS), which may contribute to increased virulence of these strains. Most RT3 and RT16 strains belong to clade IB-2 and have fewer non-core regions than the strains in other clades. This may be explained by the lack of entire rearrangement hot spot (RHS) family proteins, which function in genomic rearrangements as previously implicated in *Escherichia coli* (27). Clade IB-3 consisted of three strains, including KPA171202. Three of the four genomic islands described previously (18), GI1, GI3 and GI4, were unique to this clade and were absent in all other strains. This analysis suggests that KPA171202, although was the first sequenced complete genome of *P. acnes*, did not seem to be a common skin *P. acnes* strain representing one of the major lineages. This result is consistent with previous studies using MLST (11-13). Strains of clade IC belong to RT5. They also contain locus 3, a linear plasmid, which is highly homologous to the locus 3 in the RT4 and RT5 strains of clade IA-2 and encodes a tight adhesion locus originated from *Clostridium leptum* (4). In general, although strains in different lineages had a similar genome size with similar gain and loss of genetic materials, they harbor distinct genetic elements which may give rise to their different virulent properties.

Non-Core Genome Regions in Type II Strains

Strains in clade II, mainly RT2 and RT6, were more distantly related to the strains in clade I. Based on the metagenomic study, strains in clade II were not associated with acne, as RT2 was evenly distributed between acne patients and healthy individuals, while RT6 was significantly enriched in healthy individuals (4). Compared to type I strains, the genomes of RT2 and RT6 strains lack several regions, which are approximately 92 Kb long in total and encode 107 ORFs. RT2 and RT6 genomes have additional genomic regions with a similar size encoding 93 ORFs (FIG. 20). Based on the COG classification, there were no significant differences in the distribution of the functional categories between the 107 type I specific ORFs and 93 type II specific ORFs.

The most unique genomic feature of RT2 and RT6 strains is represented by the clustered regularly interspaced short palindromic repeats (CRISPR)/Cas locus (4). CRISPR/Cas system provides acquired bacterial immunity against viruses and plasmids by targeting nucleic acids in a sequence-specific manner (28). All the sequenced strains of RT2 and RT6 encoded a complete set of CRISPR/Cas genes and at least one repeat and spacer sequence, while none of the other ribotype strains did. Based on its complete genome sequence (20), strain ATCC11828 appeared to be an exception, having only terminal sequence but no spacer sequence. However, using PCR and sequencing it was determined that ATCC11828 has one repeat-spacer sequence (Table S2).

| CRISPR spacer sequences found in the genomes of ATCC 11828, HL042PA3 and HL202PA1. | | | | | |
|---|---|---|---|---|---|
| Strain | Ribotype | Spacer | Protospacer | BLAST result | Match found in |
| ATCC11828 | RT2 | 1 | CATCTGCCAACGAGCGAGAGTGGCGCGGTGTTC | No hits | Locus 2 |
| | | 2 | CGAGGGCTACCACGTGGTCGATTTGGACTGTCG | *Clostridium leptum* DSM 753, CLOLEP_00187, *Propionibacterium acnes* SK137, HMPREF0875_3193 (Domain of unknown function) | |
| | | 3 | CAGGCGCTCCACTCCCTCGCCCTGGCCACCAAC | No hits | |
| HL042PA3 | RT8 | 1 | CTGACTGGTTTGGGTCATACGTCTTCTGACACG | *Propionibacterium* acnes phage PA6 gp14 (Tape measure protein) *Propionibacterium* acnes phage PAD20 gp14 (Tape measure protein) *Propionibacterium* acnes phage PAS50 gp14 (Tape measure protein) | Locus 2 |
| | | 2 | TCACAGGCCACGCAGGCACATCACCCTTATTAG | *Propionibacterium* acnes phage PA6 gp15 (Minor tail protein) *Propionibacterium* acnes phage PAD20 gp15 (Minor tail protein) *Propionibacterium* acnes phage PAS50 gp15 (Minor tail protein) | |
| | | 3 | CTCCCCCTCCTCCCCGGAGGAAAAGCAGACCA | *Propionibacterium* acnes phage PAS50 gp15 (Minor tail protein) | |

CRISPR spacer sequences found in the genomes of ATCC 11828, HL042PA3 and HL202PA1.

| Strain | Ribotype | Spacer | Protospacer | BLAST result | Match found in |
|---|---|---|---|---|---|
| | | 4 | CGAGGGCTACCACGTGGTCGATTTGGACTGTCG | *Clostridium leptum* DSM 763, CLOLEP_00187, *Propionibacterium acnes* SK137, HMPREP0875_3193 (Domain of unknown function) | |
| HL202PA1 | RT6 | 1 | CGAGGGCTACCACGTGGTCGATTTGGACTGTCG | *Clostridium leptum* DSM 753, CLOLEP_00187, *Propionibacterium acnes* SK137, HMPREF0675_3193 (Domain of unknown function) | Locus 2 |
| | | 2 | CAGGCGCTCCACTCCCTCGCCCTGGCCACCAAC | No hits | |

Figure 21:
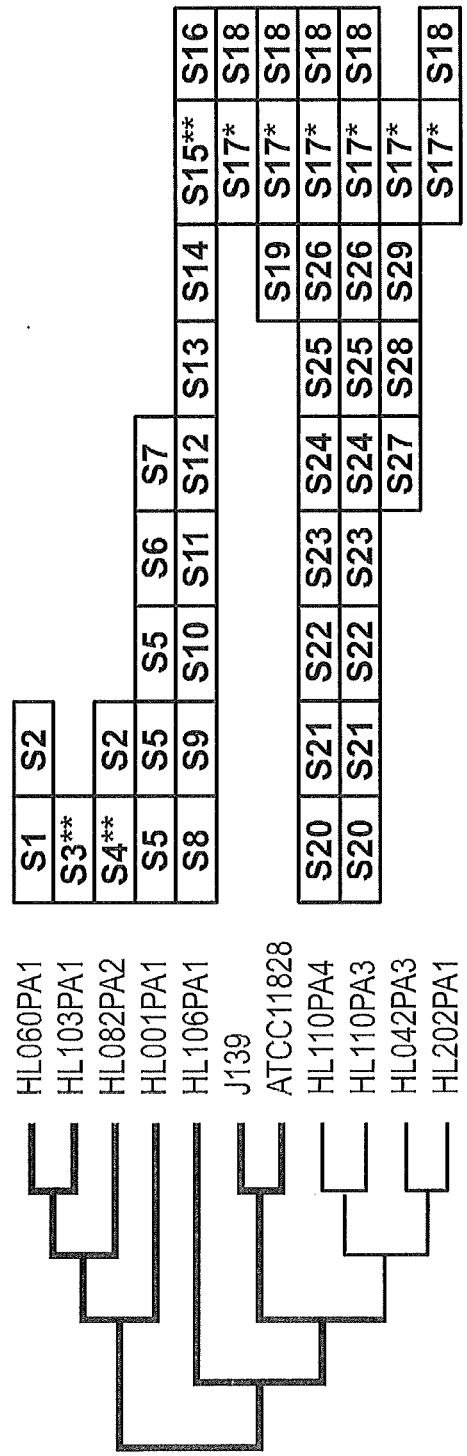
FIG. 21 provides CRISPR spacer sequences in RT2 and RT6 strains. A total of 48 CRISPR spacer sequences were found in 11 *P. acnes* genomes, 29 of which were unique. Some CRISPR spacers were found in multiple strains. For example, spacer 2 (S2) was shared by HL060PA1 and HL082PA2. Spacer 17 (S17) was shared by J139, ATCC11828, HL110PA3, HL110PA4, HL042PA3 and HL202PA1. Spacer 18 (S18) was shared by J139, ATCC11828, HL110PA3, HL110PA4, and HL202PA1. The tree was from FIG. 16 constructed based on the 123,223 SNPs in the core regions.

A total of 48 spacer sequences were found in the 11 RT2 and RT6 strains, 29 of which were unique. In other bacterial species, it has been established experimentally and computationally that the spacers at the leader-proximal end are more diversified, while the spacers at the leader-distal end are more conserved among strains. The evolutionary relationships among the RT2 and RT6 strains based on their shared spacer sequences were analyzed. HL060PA1 and HL082PA2, which were clustered tightly in clade II, shared the same spacer S2 (FIG. 21). J139, ATCC11828, HL110PA4, HL110PA3, and HL202PA1 shared the same spacers S17 and S18 (FIG. 21). These results suggest that these groups of strains probably evolved from the same ancestors before having acquired additional spacers. The relationships among the strains based on shared CRISPR spacers are consistent with the phylogenetic relationships calculated based on the SNPs in the core regions. In addition, multiple type II strains harbored spacer sequences that match to the sequences in loci 2 and 3, which were unique to mainly acne-associated RT4 and RT5 strains (4). The sequences in loci 2 and 3 appeared to be originated from *C. leptum* and encode potential virulence factors (Fig. S4). These loci may have been acquired by RT4 and RT5 strains, while the genomes of RT2 and RT6 that encode these spacers may be capable of eliminating the invasion of foreign DNA through the CRISPR mechanism (4).

The large number of high quality draft genome sequences enabled detection not only large genomic variations, but also small but essential genomic alterations. It was previously reported that type II strains showed decreased lipase activity (10). Lipase functions in hydrolyzing triglycerides and releasing free fatty acids, which is thought to be essential in *P. acnes* virulence. Based on the genome annotation, 13 genes were identified with a potential function of lipase (FIG. 22)(A). Among them, detected insertions/deletions ranging from one nucleotide to 13 nucleotides may explain the decreased lipase activity in type II strains. Two triacylglycerol lipases were encoded in tandem in *P. acnes* genomes, HMPREF0675-4855 and HMPREF0675-4856 (according to the annotation of SK137). All the type II strains and IB-3 strains had a deletion of the "TATA-box" 20 bp upstream of the start codon of the second lipase gene, HMPREF0675-4856 (FIG. 22) (B). In addition, there was a one-nucleotide deletion at the position of 124G of the second lipase gene, leading to a frameshift and the introduction of a premature stop codon. These two deletions may potentially explain the decreased lipase activity and hence decreased virulence in acne observed in type II strains in previous studies (4, 10).

Non-Core Genome Regions in the Type III Strain

Type III strains are rarely found on the skin surface. A type III *P. acnes* strain isolated from refractory endodontic lesion, HL201 PA1, was sequenced. This first available type III genome permitted the identification of the genetic elements specific to this lineage. Compared to type I and type II strains, the genome of HL201 PA1 lacks a few regions with a total length of 43 Kb (FIG. 20). There were 42 ORFs encoded in these regions, including anaerobic dimethyl sulfoxide reductase (PPA0516-PPA0517), iron(III) dicitrate transport system permease (PPA0792-PPA0793), 3-isopropylmalate dehydratase (PPA1361-PPA1363), and maltose transport system permease (PPA1553-PPA1554).

Discussion

High-throughput genome sequencing and comparative analysis of a large number of related strains have been used to study the spread and microevolution of several pathogens at the strain level, including methicillin-resistant *Staphylococcus aureus* (29), *Streptococcus pneumoniae* (30), and *Vibrio cholerae* in Haiti outbreak (31), demonstrating the power of comparative genome analysis of multiple strains in improving our understanding of the bacterial pathogens. However, this approach has been rarely applied to study commensal species to understand their varied virulent potentials among different strains and their roles in both health and diseases.

This study presents a comparative genome analysis of a major skin commensal, *P. acnes*, based on a large number of sequenced strains. This collection of strains not only includes strains associated with either healthy skin or acne, but also a large number of strain pairs that were isolated from the same individuals. This allowed the comparison of phylogenetic relationships and microevolution of the *P. acnes* strains associated with health vs. disease as well as of the strains in the same individual microbiome.

By comparing 82 *P. acnes* genomes, it was shown that all *P. acnes* strains had a similar genome size with a similar GC content, encoding 2,577 ORFs on average (Table 1). Although *P. acnes* has an open pan-genome, unlike many other open-genome species (24), it has limited genome expansion with only a few new genes added per genome (FIGS. 13 and 14). The rate of genome expansion is similar within the major lineages (FIG. 17). There was limited recombination among different *P. acnes* strains, and thus 16S rRNA ribotypes can be used as a proxy for *P. acnes* strain identification and classification (FIG. 16). Compared to other typing methods, 16S ribotyping has a much higher resolution than recA typing and is much easier and faster than the traditional MLST method. This method can be applied in a high-throughput manner by combining with next-generation sequencing, and thus allows one to detect the microbiome variations at the strain level (4). This is advantageous and important, as identifying and understanding the strain level variations of the human microbiome is medically important.

Figure 19:
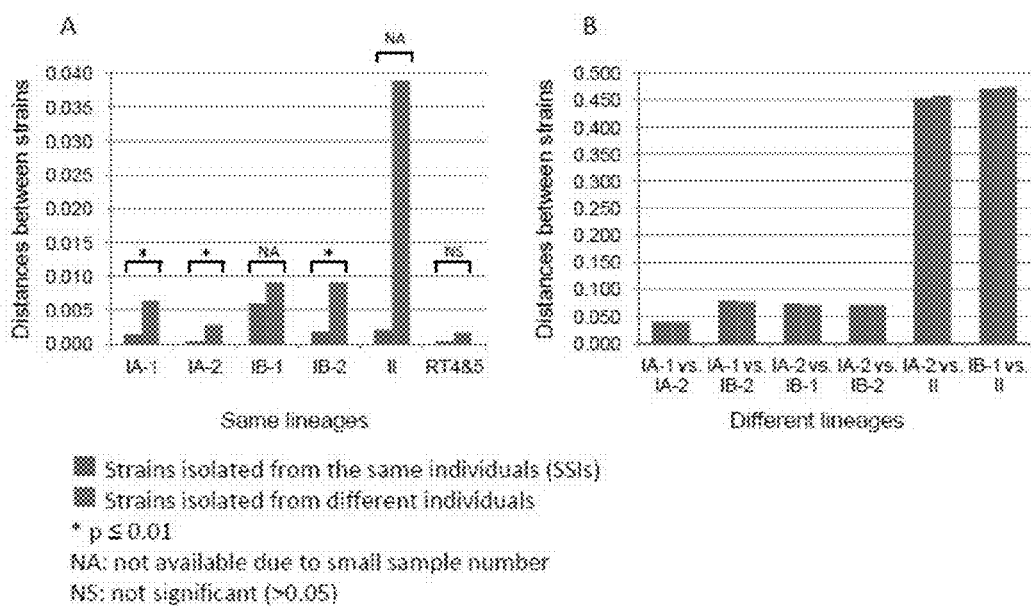
FIG. 19 provides the distances between *P. acnes* strains in the same lineage (A) and in different lineages (B).

The genomes of the sets of strains isolated from the same individual samples were compared (FIGS. 16 and 19). This collection of genome data is unique and no such kind of study has been performed to investigate the microevolution of a human commensal within an individual microbiome. It was found that while multiple P. acnes strain populations co-existed in the same individual microbiome, clonal expansions occurred in each population with little recombination among different populations. Within each lineage, the strains isolated from the same individuals were significantly more similar to each other than strains from different individuals except the disease associated strains, RT4 and RT5 strains (FIG. 19). Although isolated from different individuals, they appeared to be clonal and have evolved from the same virulent ancestor strain (FIG. 16). This supports the observation that these strains were transmissible (26) and that they may play a role in acne pathogenesis (4). This finding is important and will help control the spread of antibiotic resistant strains and develop new targeted therapy for acne.

Figure 22:
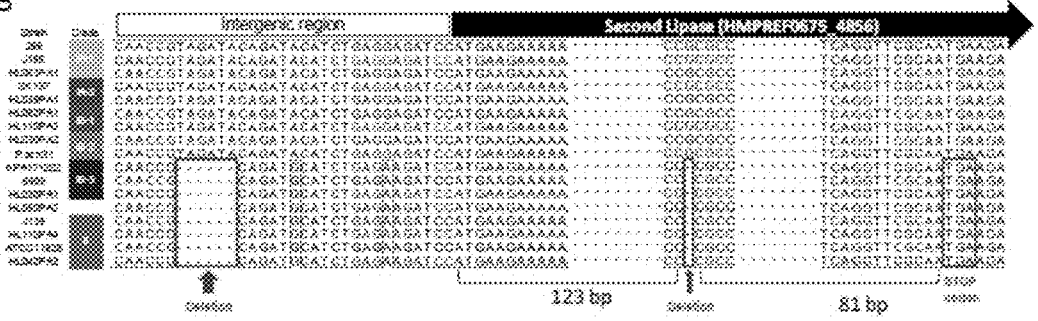
FIG. 22 reflects genes with putative lipase activity in the *P. acnes* genomes. (A) gives a summary of 13 genes with putative lipase activity based on the annotations of KPA171202 and SK137 genomes. (B) reflects Insertions/deletions and frameshift observed in ORF HMPREF0675-4856.

By analyzing the non-core regions, the genomic elements and alterations specific to each lineage were identified (FIG. 20). These lineage-specific elements may render the strains different physiological and functional properties and thus lead to their different roles as a commensal in health or as a pathogen in diseases. Among the acne associated strains, RT4 and RT5 strains encode three distinct loci originated from mobile elements, and RT8 strains encode a distinct region containing a set of NRPS. The virulent genes encoded in these strain-specific regions may explain the associations of these strains with acne and help the development of new drugs targeting against these strains. RT2 and RT6 strains, which were not associated with acne and were enriched in healthy skin, respectively, all encode CRISPR/cas elements. The CRISPR mechanism may prevent these strains from acquiring virulent genes from invading foreign mobile elements. In addition, these strains contain genomic variations in lipases that may alter lipid metabolism and reduce their virulence (FIG. 22).

In conclusion, by characterizing the genetic landscape and diversity of P. acnes with a large number of genomes, genomic evidence that may explain the diverse phenotypes of P. acnes strains and a new insight into the dual role of this commensal in human skin health and disease is provided. The findings from this comparative genome analysis provide new perspectives on the strain diversity and evolution of commensals in the human microbiome. As many current microbiome studies focus on the associations of microbial communities with health and diseases, this study underscores the importance of understanding the commensal microbiome at the strain level (25). The findings from this study also shed light on new strain-specific therapeutics for acne and other P. acnes associated diseases.

Materials and Methods

P. acnes Strains

Among the 69 P. acnes strains that were sequenced, 67 were isolated from the skin microcomedone samples from acne patients and healthy individuals (4). The other two strains, HL201 PA1 and HL202PA1, were isolated from refractory endodontic lesions (23), provided by Dr. David Beighton at the King's College London.

Whole Genome Shotgun Sequencing, Assembly, and Annotation

The genome of HL042PA3 was sequenced using Roche/454 FLX and assembled using a combination of PHRAP/CONSED (32) and GSMAPPER (Roche). HL201 PA1 and HL202PA1 were sequenced using Illumina MiSeq (250 bp, paired-end) and assembled using Velvet (33). The remaining 66 genomes were sequenced previously as described (4). Coding sequences were predicted using GeneMark (34) and GLIMMER (35).

Computation of the Core Regions, Non-Core Regions and the Pan-Genome

The core regions were defined as genome sequences that were present in all 82 genomes, while the non-core regions were defined as genome sequences that were not present in all the genomes. KPA171202 was used as the reference genome. Each of the other 81 genome sequences (a series of contigs in most of the genomes and ten complete genomes) was mapped to the reference genome using Nucmer (36). All the 81 ".coords" output files of Nucmer program were analyzed to identify overlap regions based on the KPA171202 coordinates using a Perl script. Core sequences were then extracted based on the genome sequence of KPA171202 with the coordinates calculated above.

The unique regions from each genome were added to the reference genome to make a "revised" reference genome, which contained the original sequence plus the unique genome sequences. This process was repeated for all the genomes until all the unique regions from all genomes were included in the pan-genome.

Lastly, core regions were subtracted from the pan-genome. The remaining regions were defined as non-core regions, which are not shared by all the strains. Protein coding sequences were predicted by GeneMark.hmm using KPA171202 as a reference file.

Identification of SNPs in the Core Regions

Single nucleotide polymorphisms (SNPs) were identified by using "show-snps" utility option of the Nucmer program with the default settings (36). Genome sequence of KPA171202 was used as the reference genome. All the 81 ".snps" output files of Nucmer program were analyzed to identify unique SNP positions based on the KPA171202 coordinates using a Perl script.

Phylogenetic Tree Construction

The 82 concatenated sequences of the 123,223 SNP nucleotides in the core region were used to construct a phylogenetic tree of the P. acnes genomes. MEGA5 (37) was used to calculate the distance based on the SNPs in the core regions using the Neighbor-Joining method and the p-distance method. The bootstrap tree inferred from 200 replicates was taken.

Sequence Type Analysis Based on MLST Schemes

The sequence types of the 82 isolates were determined based on the MLST schemes published previously (11-13). The MLST gene sequences were aligned using BLAST against all the alleles used in the two MLST schemes.

Identification of CRISPR/Cas

CRISPRFinder (38) was used to identify the CRISPR repeat-spacer sequences. The annotation of HL110PA3 was used for BLAST alignment in order to identify the presence of CRISPR/Cas structure and CRISPR repeat-spacer sequences in strains of HL001PA1, HL060PA1, HL042PA3, HL082PA2, HL103PA1, HL106PA1, HL110PA4, HL202PA1, J139 and ATCC11828. Each spacer sequence was annotated by BLAST (39) against NCBI's non-redundant nucleotide database and the reference genomic sequences database (refseq_genomic).

Hierarchical Clustering Analysis of the Non-Core Regions

Among the 1,685 non-core fragments (895,905 bp in total), 314 non-core fragments with a length of >500 bp (747,189 bp in total, corresponding to 83% of all the non-core regions) were extracted and used in hierarchical clustering of the non-core regions. Cluster 3.0 program (40) and average linkage method was used. The clustering matrix was composed of 314 rows and 82 columns, in which 1 denotes presence of the non-core region and 0 denotes absence of the non-core region. Java TreeView program (41) was used to display the clustering result.

REFERENCES

1. Grice E A, Segre J A. 2011. The skin microbiome. Nat Rev Microbiol 9:244-253.
2. White G M. 1998. Recent findings in the epidemiologic evidence, classification, and subtypes of acne vulgaris. J Am Acad Dermatol 39:S34-37.
3. precedings.nature.com/documents/5305/version/1
4. Fitz-Gibbon S T, Tomida S, Chiu B, Nguyen L, Du C, Liu M, Elashoff D, Erfe M C, Loncaric A, Kim J, Modlin R L, Miller J F, Sodergren E, Craft N, Weinstock G M, Li H. Propionibacterium acnes strain populations in the human skin microbiome associated with acne. Journal of Investigative Dermatology (in press).
5. Chambers H F, Deleo F R. 2009. Waves of resistance: Staphylococcus aureus in the antibiotic era. Nat Rev Microbiol 7:629-641.
6. Chase-Topping M, Gaily D, Low C, Matthews L, Woolhouse M. 2008. Super-shedding and the link between human infection and livestock carriage of Escherichia coli O157. Nat Rev Microbiol 6:904-912.
7. Johnson J L, Cummins C S. 1972. Cell wall composition and deoxyribonucleic acid similarities among the anaerobic coryneforms, classical propionibacteria, and strains of Arachnia propionica. J Bacteriol 109:1047-1066.
8. McDowell A, Valanne S, Ramage G, Tunney M M, Glenn J V, McLorinan G C, Bhatia A, Maisonneuve J F, Lodes M, Persing D H, Patrick S. 2005. Propionibacterium acnes types I and II represent phylogenetically distinct groups. J Clin Microbiol 43:326-334.
9. Valanne S, McDowell A, Ramage G, Tunney M M, Einarsson G G, O'Hagan S, Wisdom G B, Fairley D, Bhatia A, Maisonneuve J F, Lodes M, Persing D H, Patrick S. 2005. CAMP factor homologues in Propionibacterium acnes: a new protein family differentially expressed by types I and II. Microbiology 151:1369-1379.
10. McDowell A, Perry A L, Lambert P A, Patrick S. 2008. A new phylogenetic group of Propionibacterium acnes. J Med Microbiol 57:218-224.
11. Lomholt H B, Kilian M. 2010. Population genetic analysis of Propionibacterium acnes identifies a subpopulation and epidemic clones associated with acne. PLoS One 5:e12277.
12. McDowell A, Gao A, Barnard E, Fink C, Murray P I, Dowson C G, Nagy I, Lambert P A, Patrick S. 2011. A novel multilocus sequence typing scheme for the opportunistic pathogen Propionibacterium acnes and characterization of type I cell surface-associated antigens. Microbiology 157:1990-2003.
13. McDowell A, Barnard E, Nagy I, Gao A, Tomida S, Li H, Eady A, Cove J, Nord C E, Patrick S. 2012. An Expanded Multilocus Sequence Typing Scheme for Propionibacterium acnes: Investigation of 'Pathogenic', 'Commensal' and Antibiotic Resistant Strains. PLoS One 7:e41480.
14. Bruggemann H, Henne A, Hoster F, Liesegang H, Wiezer A, Strittmatter A, Hujer S, Durre P, Gottschalk G. 2004. The complete genome sequence of Propionibacterium acnes, a commensal of human skin. Science 305: 671-673.
15. The Human Microbiome Project Consortium. 2012. A framework for human microbiome research. Nature 486: 215-221.
16. The Human Microbiome Project Consortium. 2012. Structure, function and diversity of the healthy human microbiome. Nature 486:207-214.
17. Nelson K E, Weinstock G M, Highlander S K, Worley K C, Creasy H H, Wortman J R, Rusch D B, Mitreva M, Sodergren E, Chinwalla A T, Feldgarden M, Gevers D, Haas B J, Madupu R, Ward D V, Birren B W, Gibbs R A, Methe B, Petrosino J F, Strausberg R L, Sutton G G, White O R, Wilson R K, Durkin S, Giglio M G, Gujja S, Howarth C, Kodira C D, Kyrpides N, Mehta T, Muzny D M, Pearson M, Pepin K, Pati A, Qin X, Yandava C, Zeng Q, Zhang L, Berlin A M, Chen L, Hepburn T A, Johnson J, McCorrison J, Miller J, Minx P, Nusbaum C, Russ C, Sykes S M, Tomlinson C M, Young S, Warren W C, Badger J, Crabtree J, Markowitz V M, Orvis J, Cree A, Ferriera S, Fulton L L, Fulton R S, Gillis M, Hemphill L D, Joshi V, Kovar C, Torralba M, Wetterstrand K A, Abouellleil A, Wollam A M, Buhay C J, Ding Y, Dugan S, FitzGerald M G, Holder M, Hostetler J, Clifton S W, Allen-Vercoe E, Earl A M, Farmer C N, Liolios K, Surette M G, Xu Q, Pohl C, Wilczek-Boney K, Zhu D. 2010. A catalog of reference genomes from the human microbiome. Science 328:994-999.
18. Brzuszkiewicz E, Weiner J, Wollherr A, Thurmer A, Hupeden J, Lomholt H B, Kilian M, Gottschalk G, Daniel R, Mollenkopf H J, Meyer T F, Bruggemann H. 2011. Comparative genomics and transcriptomics of Propionibacterium acnes. PLoS One 6:e21581.
19. Hunyadkurti J, Feltoti Z, Horvath B, Nagymihaly M, Voros A, McDowell A, Patrick S, Urban E, Nagy I. 2011. Complete genome sequence of Propionibacterium acnes type IB strain 6609. J Bacteriol 193:4561-4562.
20. Horvath B, Hunyadkurti J, Voros A, Fekete C, Urban E, Kemeny L, Nagy I. 2012. Genome sequence of Propionibacterium acnes type II strain ATCC 11828. J Bacteriol 194:202-203.
21. Voros A, Horvath B, Hunyadkurti J, McDowell A, Barnard E, Patrick S, Nagy I. 2012. Complete genome sequences of three Propionibacterium acnes isolates from the type IA(2) cluster. J Bacteriol 194:1621-1622.
22. McDowell A, Hunyadkurti J, Horvath B, Voros A, Barnard E, Patrick S, Nagy I. 2012. Draft genome sequence of an antibiotic-resistant Propionibacterium acnes strain, PRP-38, from the novel type I C cluster. J Bacteriol 194:3260-3261.
23. Niazi S A, Clarke D, Do T, Gilbert S C, Mannocci F, Beighton D. 2010. Propionibacterium acnes and Staphylococcus epidermidis isolated from refractory endodontic lesions are opportunistic pathogens. J Clin Microbiol 48:3859-3869.
24. Tettelin H, Riley D, Cattuto C, Medini D. 2008. Comparative genomics: the bacterial pan-genome. Curr Opin Microbiol 11:472-477.
25. Schloissnig S, Arumugam M, Sunagawa S, Mitreva M, Tap J, Zhu A, Waller A, Mende D R, Kultima J R, Martin J, Kota K, Sunyaev S R, Weinstock G M, Bork P. 2013. Genomic variation landscape of the human gut microbiome. Nature 493:45-50.

26. Ross J I, Snelling A M, Carnegie E, Coates P, Cunliffe W J, Bettoli V, Tosti G, Katsambas A, Galvan Perez Del Pulgar J I, Rollman O, Torok L, Eady E A, Cove J H. 2003. Antibiotic-resistant acne: lessons from Europe. The British journal of dermatology 148:467-478.
27. Jackson A P, Thomas G H, Parkhill J, Thomson N R. 2009. Evolutionary diversification of an ancient gene family (rhs) through C-terminal displacement. BMC Genomics 10:584.
28. Horvath P, Barrangou R. 2010. CRISPR/Cas, the immune system of bacteria and archaea. Science 327:167-170.
29. Harris S R, Feil E J, Holden M T, Quail M A, Nickerson E K, Chantratita N, Gardete S, Tavares A, Day N, Lindsay J A, Edgeworth J D, de Lencastre H, Parkhill J, Peacock S J, Bentley S D. 2010. Evolution of MRSA during hospital transmission and intercontinental spread. Science 327:469-474.
30. Croucher N J, Harris S R, Fraser C, Quail M A, Burton J, van der Linden M, McGee L, von Gottberg A, Song J H, Ko K S, Pichon B, Baker S, Parry C M, Lambertsen L M, Shahinas D, Pillai D R, Mitchell T J, Dougan G, Tomasz A, Klugman K P, Parkhill J, Hanage W P, Bentley S D. 2011. Rapid pneumococcal evolution in response to clinical interventions. Science 331:430-434.
31. Chin C S, Sorenson J, Harris J B, Robins W P, Charles R C, Jean-Charles R R, Bullard J, Webster D R, Kasarskis A, Peluso P, Paxinos E E, Yamaichi Y, Calderwood S B, Mekalanos J J, Schadt E E, Waldor M K. 2011. The origin of the Haitian cholera outbreak strain. The New England journal of medicine 364:33-42.
32. Gordon D, Abajian C, Green P. 1998. Consed: a graphical tool for sequence finishing. Genome Res 8:195-202.
33. Zerbino D R, Birney E. 2008. Velvet: algorithms for de novo short read assembly using de Bruijn graphs. Genome Res 18:821-829.
34. Borodovsky M, McIninch J. 1993. Recognition of genes in DNA sequence with ambiguities. Biosystems 30:161-171.
35. Salzberg S L, Delcher A L, Kasif S, White O. 1998. Microbial gene identification using interpolated Markov models. Nucleic Acids Res 26:544-548.
36. Kurtz S, Phillippy A, Delcher A L, Smoot M, Shumway M, Antonescu C, Salzberg S L. 2004. Versatile and open software for comparing large genomes. Genome Biol 5:R12.
37. Tamura K, Peterson D, Peterson N, Stecher G, Nei M, Kumar S. 2011. MEGA5: molecular evolutionary genetics analysis using maximum likelihood, evolutionary distance, and maximum parsimony methods. Mol Biol Evol 28:2731-2739.
38. Grissa I, Vergnaud G, Pourcel C. 2007. CRISPRFinder: a web tool to identify clustered regularly interspaced short palindromic repeats. Nucleic Acids Res 35:W52-57.
39. Altschul S F, Gish W, Miller W, Myers E W, Lipman D J. 1990. Basic local alignment search tool. J Mol Biol 215:403-410.
40. de Hoon M J, Imoto S, Nolan J, Miyano S. 2004. Open source clustering software. Bioinformatics 20:1453-1454.
41. Saldanha A J. 2004. Java Treeview—extensible visualization of microarray data. Bioinformatics 20:3246-3248.

Example 3—Microbial DNA Extraction from Skin Samples

Skin Microcomedone Sampling

Skin microcomedone (white head or black head) samples were taken from the skin of the subjects using a specialized adhesive tape. The skin was moistened with water before the adhesive tape was put on. The tape was left on the skin for 15-20 minutes until it became dry. Clean gloves were used for each sampling. After being taken off from the skin, the tape was placed into a 50 mL sterile tube. This can be applied to many skin sites, such as the nose, forehead, chin, and back.

Bacterial DNA Extraction

Microcomedones were individually picked or scraped off from the adhesive tape using sterile forceps and placed in a 2 mL sterile microcentrifuge tube filled with Buffer ATL (Qiagen) and 0.1 mm diameter glass beads (BioSpec Products, Inc., Bartlesville, Okla.). Cells were lysed using a beadbeater for 3 minutes at 4,800 rpm at room temperature. After centrifugation at 14,000 rpm for 5 minutes, the supernatant was retrieved and used for genomic DNA extraction using QIAamp DNA Micro Kit (Qiagen). The manufacturer protocol for extracting DNA from chewing gum was used. Concentration of the genomic DNA was determined by a spectrometer.

Example 4—Microbiome Type Detection

Detailed Protocol for Accurate Detection of the Skin Microbiome Type Based on 16S rDNA PCR Amplification, Cloning, and Sequencing 16S rDNA was amplified using primers 8F (5'-AGAGTTTGATYMTGGCTCAG-3') and 1510R (5'-TACGGYTACCTTGTTACGACTT-3'). Thermocycling conditions were as following: initial denaturation step of 5 minutes at 94° C., 30 cycles of denaturation at 94° C. for 45 seconds, annealing at 52° C. for 30 seconds and elongation at 72° C. for 90 seconds, and a final elongation step at 72° C. for 20 minutes. PCR products were purified using column-based method. Subsequently, the 16S rDNA amplicons were cloned into pCR 2.1-TOPO vector (Invitrogen). One-Shot TOP-10 Chemically Competent *E. coli* cells (Invitrogen) were transformed with the vectors and plated on selective media. Individual positive colonies were picked and inoculated into selective LB liquid medium. After 14 hours of incubation, the plasmids were extracted and purified, either using column-based plasmid extraction kit or traditional methods. The clones were sequenced bidirectionally using Sanger sequencing method. The microbiome type of each individual was determined based on the 16S rDNA sequence data of the top 10 major ribotypes. See FIG. 5 and SEQ ID NOs 1-10.

Detailed Protocols for Fast Detection of the Skin Microbiome Type Based on PCR and qPCR By sequencing and annotating 69 novel *P. acnes* genomes and by comparing a total of 82 *P. acnes* genomes, several genomic loci which are unique to acne associated *P. acnes* strains were identified, i.e., Loci 1-4. See FIG. 8. The genomic sequences of Loci 1, 2, 3, and 4 from all sequences *P. acnes* strains and their sequence similarities, which range from 95% to 100%, are listed as SEQ ID NOs 15-18, respectively.

Detection Method 1

Figure 23A:
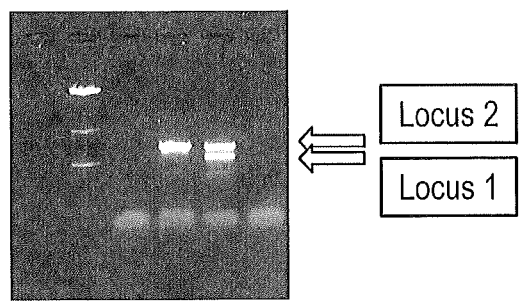
FIG. 23 reflects fast detection of acne associated *P. acnes* strains using multiplex PCR targeting loci 1, 2, and 3.
Figure 23B:
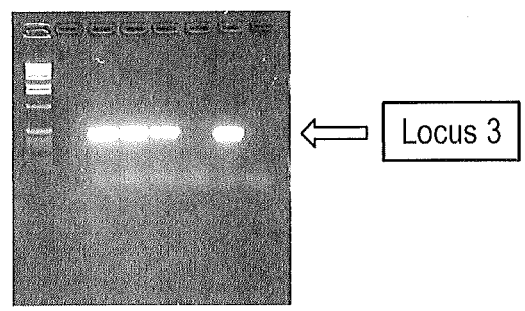

To rapidly detect the presence or absence of RT4 and RT5 strains in patients, multiplex PCR targeting Loci 1, 2, and 3 was designed and performed on genomic DNA extracted from *P. acnes* strains and skin samples. FIG. 23 shows that Loci 1, 2, and 3 were amplified from various *P. acnes* strains as predicted based on the genome data.

The PCR primer sequences are shown in Table 1:

TABLE 1

Primers specific for loci 1, 2, 3 and Pak (housekeeping gene)

| Target locus | Forward primer | Reverse primer |
|---|---|---|
| Locus 1 | GGTATCCACCGAGATGGAAG (SEQ ID NO: 11) | GTGGTCCCAGGTGACATTCT (SEQ ID NO: 12) |
| Locus 2 | CGACATCGACGTTTCATCTG (SEQ ID NO: 13) | GTGTTCTCCTCGTGCTGGTT (SEQ ID NO: 14) |
| Locus 3 | GATAATCCGTTCGACAAGCTG (SEQ ID NO: 15) | ACCCACCACGATGATGTTT (SEQ ID NO: 16) |
| Pak | CGACGCCTCCAATAACTTCC | GTCGGCCTCCTCAGCATC |

Additional primers targeting these loci can be designed based on the genome sequences of loci 1-4 (SEQ ID NOs 15-18), respectively). Each 20 μL reaction contains 12.7 μL molecular grade H2O, 2 μL 10× High Fidelity Buffer, 0.6 μL 50 mM MgSO4, 0.4 μL 10 nM dNTP, 0.8 μL of each primer (final primer concentrations is 400 nM), 0.1 μL Platinum Taq DNA Polymerase High Fidelity (All reagents from Invitrogen) and 1 μL gDNA template (approx. 40 ng gDNA). The thermocycling conditions are as following: initial denaturation step of 10 minutes at 95° C.; 35 cycles with each consisting of 45 seconds at 95° C., 30 seconds at 65° C. and 45 seconds at 72° C.; and final elongation step of 10 minutes at 72° C.

To quantitatively measure the abundance of acne associated *P. acnes* strains in skin samples, quantitative PCR (qPCR) targeting Loci 1, 2, and 3 were performed on genomic DNA extracted from *P. acnes* strains. See FIG. 12. LightCyler 480 High Resolution Melting Master kit was used (Roche Diagnostics GmbH, Mannheim, Germany). Each 10 μL reaction contains 5 μL of Master Mix (2× concentrate), 1 μL of 25 mM MgCl2, 0.5 μL of 4 μM forward and reverse primers, 1 μL to 3.5 μL of DNA template (approximately 2.5 ng DNA), and molecular grade H2O, up to the volume. The thermocycling conditions were as following: initial activation step of 10 minutes at 95° C.; 40 amplification cycles with each consisting of 10 seconds at 95° C., 15 seconds at 65° C. during first cycle, but with a stepwise 0.5° C. decrease for each succeeding cycle and 30 seconds at 72° C.; and finally, a melting curve step, starting at 65° C. and ending at 99° C., with ramp rate of 0.02° C./s and acquisition rate of 25 per ° C.

The protocol was tested using mock samples, where different strains of *P. acnes* were mixed in different proportions to mimic the strain population distributions in real samples. See Table 2.

TABLE 2

Mock samples mimicking the microbiome types observed in human skin samples

| Mock sample | Microbiome type | Dominant isolate | Percentage of dominant isolate | Abundance of Locus 1 | Abundance of Locus 2 |
|---|---|---|---|---|---|
| 1A | I | HL036PA3 | 80 | 7.5% | 7.5% |
| 1B | I | HL078PA1 | 80 | 7.5% | 87.5% |
| 1C | I | HL106PA2 | 80 | 87.5% | 87.5% |
| 2 | II | HL103PA1 | 80 | 8.0% | 10.0% |
| 3 | III | HL087PA3 | 80 | 8.0% | 10.0% |
| 4 | IV | HL038PA1 | 70 | 79.0% | 82.0% |
| 5A | V | HL072PA2 | 80 | 6.7% | 8.9% |
| 5B | V | HL096PA1 | 80 | 86.7% | 88.9% |
| 6 | minor | HL110PA4 | 70 | 12.0% | 15.0% |
| 8A | minor | HL086PA1 | 70 | 80.0% | 83.3% |
| 8B | minor | HL092PA1 | 70 | 10.0% | 13.3% |

Figure 24:
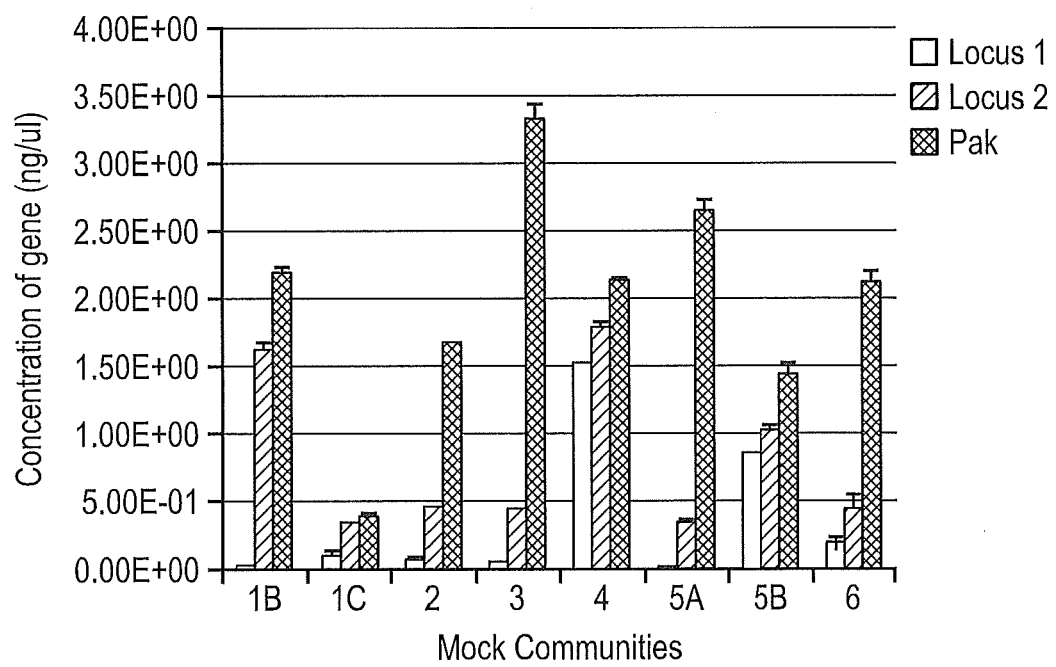
FIG. 24 shows the relative abundances of Locus 1 and Locus 2 as compared to the housekeeping gene Pak.
Figure 25:
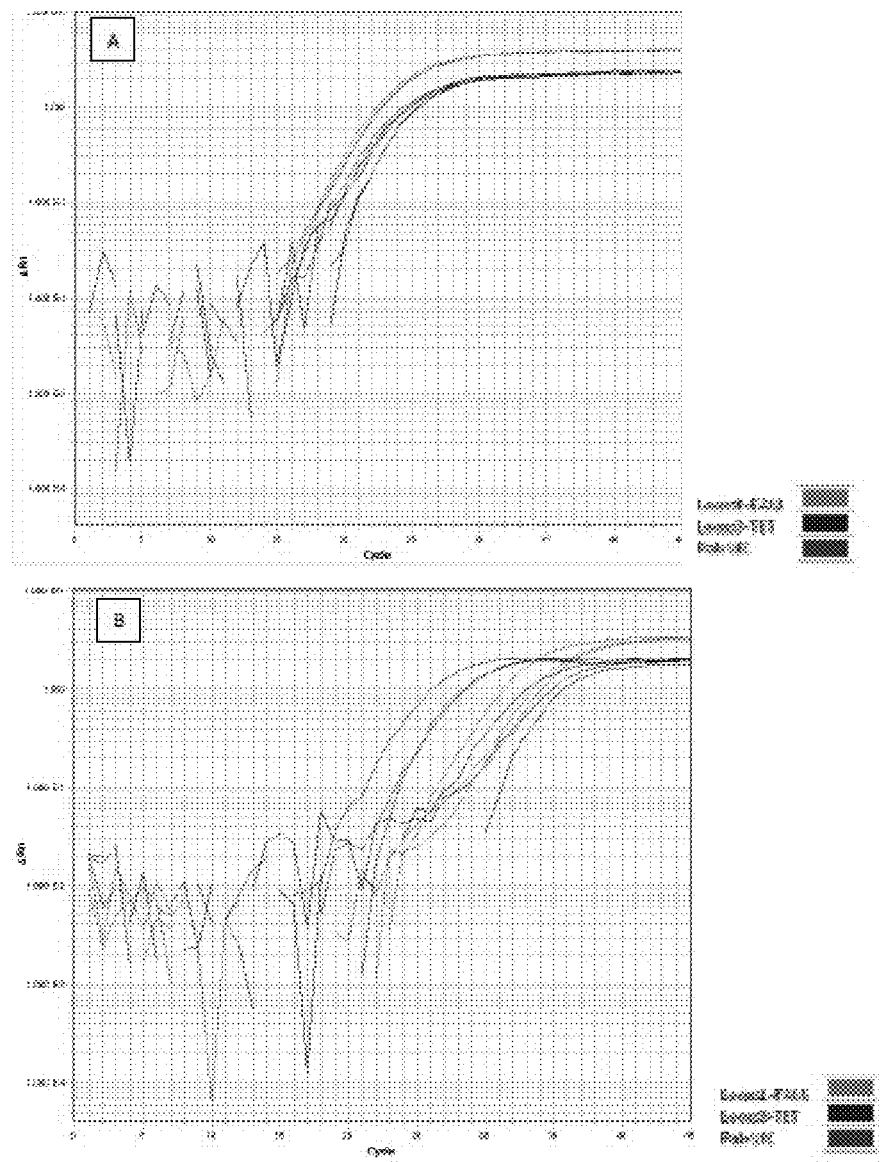
FIG. 25 reflects qPCR triplex amplification plots for clinical samples #1 (A) and #2 (B) showing amplification of *P. acnes* Locus 1, Locus 3, and Pak.

The concentration of each locus was quantified from standards derived from Locus 1, Locus 2, and Pak PCR amplicons. The copy number of each gene was quantified from genomic DNA standards that were derived from TadA (in Locus 3) and Pak amplicons using conventional PCR. See FIG. 24.

Detection Method 2

*P. acnes* TaqMan qPCR Assay

Primer and Probe Design

Primers and probes for detecting Loci 1, 2, 3, and 4 in *P. acnes* strains and clinical samples were designed as listed in Table 3:

TABLE 3

Primer and Probe sequences used for identification of P. acnes loci

| Targeted region | Primer/Probe | Primer Probe name | Sequence (5'-3') | Amplicon size (bp) |
|---|---|---|---|---|
| Locus 1 | forward primer | Locus1_F | GAAGAATCCCGCTCCATTTCC (SEQ ID NO: 17) | 107 |
| | reverse primer | Locus1_R | CCTTTCTTGTAGCCGAGCAG (SEQ ID NO: 18) | |
| | probe | Locus1_Probe | 56-FAM/ATTGTCACC/ZEN/TGGGACCACCACCGTAAAC/31ABkFQ (SEQ ID NO: 19) | |
| Locus 2 | forward primer | Locus2_F | GGTGATCCTGATCGACTGTG (SEQ ID NO: 20) | 103 |
| | reverse primer | Locus2_R | GCTCCACAACTTCGAGTGC (SEQ ID NO: 21) | |
| | probe | Locus2_Probe | CAGGCCGTTGATCGTGAGCTGA (SEQ ID NO: 22) | |

TABLE 3-continued

Primer and Probe sequences used for identification of *P. acnes* loci

| Targeted region | Primer/Probe | Primer Probe name | Sequence (5'-3') | Amplicon size (bp) |
|---|---|---|---|---|
| Locus 3 | forward primer | Locus3_F | TGCTGATAATCCGTTCGACA (SEQ ID NO: 23) | 104 |
|  | reverse primer | Locus3_R | ACGACGTCGAAAACAACTCC (SEQ ID NO: 24) |  |
|  | probe | Locus3_Probe | 5TET/CTCTACCGA/ZEN/ AGCTCTTGCCGCAT/31ABkFQ (SEQ ID NO: 25) |  |
| Locus 4 | forward primer | Locus4_F | ATCGCCGTCGACAGGTAGT (SEQ ID NO: 26) | 103 |
|  | reverse primer | Locus4_R | CCGAGATTCTGCGCCTAGT (SEQ ID NO: 27) |  |
|  | probe | Locus4_Probe | CGGTGCCCTTGCTGAGGTACA (SEQ ID NO: 28) |  |
| Pak | forward primer | Pak_F | GCAACCCGACATCCTCATTA | 101 |
|  | reverse primer | Pak_R | AGTCGAAGAAGTCGCTCAGG |  |
|  | probe | Pak_Probe | VIC/CGTTCTACAGCCACCACGACGG/ TAMRA |  |

A triplex Taqman qPCR was designed and tested using *Propionibacterium* specific primers to target Locus 1, Locus 3, and an internal control, Pak, present in all *P. acnes*.

Locus 1, Locus 3, and Pak Amplification

Benchtop amplification was carried out to assess specificity of designed primers and to determine optimum cycling conditions prior to multiplexing. Amplification was carried out using a BioRad C1000 thermal cycler. Singleplex PCR reactions contained 0.2 µM target specific primers, 10× Platinum Taq buffer (Invitrogen), 1.0 mM MgCl2, 0.2 mM each dNPT, 0.5 U/µl Platinum Taq polymerase, 1 µl DNA template and made up to a final volume of 10 µl. Cycling was as follows: initial denaturation 94° C. for 5 minutes, followed by 30 cycles of denaturation at 94° C. for 30 seconds, annealing at 60° C. for 30 seconds and extension at 72° C. for 30 seconds, and one final extension cycle at 72° C. for 5 minutes. Amplification products were analysed electrophoretically on a 1% agarose/TBE gel to check for correct amplification of target and cross-species reactivity with primer targets.

Taqman Triplex PCR

Triplex qPCR was carried out using an Applied Biosystems 7900HT instrument. 1-2 µl of sample DNA were added to mastermix containing X2 QuantiTect Multiplex PCR Master Mix (Qiagen), 0.2 µM primers; Locus1_F, Locus1_R, Pak_F, Pak_R; 0.2 µM probes; Locus1_Probe and Pak_Probe, and 0.1 µM primers Locus3_F and Locus3_R, and 0.1 µM Locus3_Probe. The reaction mix was made up to a final volume of 20 µl with sterile PCR grade water. The PCR program consisted of one cycle at 50° C. for 2 minutes, followed by one cycle at 95° C. for 15 minutes to allow for activation of the multiplex mastermix, then 45 cycles of 94° C. for 60 seconds and 57° C. for 90 seconds. Each run contained calibrators of extracted *P. acnes* DNA from culture, as well as no-template controls (NTC) and water controls. qPCR was run with a passive reference, ROX, supplied in the Quantitect Multiplex PCR mastermix. Data were analysed using the SDS v2.4 software.

Assay Calibration, Sensitivity, and Specificity

Calibrations curves for *P. acnes* targets Locus 1 and Pak were constructed by plotting mean Ct values for a series of log dilutions of quantified genomic DNA standards extracted from *P. acnes* from pure culture. Genome equivalents were estimated. Five replicates of *P. acnes* calibrators were used to calculate mean Ct values and standard deviations. These data were used to determine sensitivity of the assay and the limits of detection (LOD). Calibration plots were used to determine the number of *P. acnes* genomes in clinical samples, with one copy of Locus1 and Pak targets per genome. DNA concentration and copy number were determined and serial ten-fold dilutions of the purified product were used as standards for construction of the Locus3 calibration plot. Strains that display possible combinations of the presence and absence of Locus1 and Locus 3 were used for Locus1 and Pak calibration: HL038PA1 (Locus1+, Locus3+), HL083PA1 (Locus1+, Locus3−), HL078PA1 (Locus1−, Locus3+) and HL063PA1 (Locus1−, Locus3−). The assay was validated using sequenced *P. acnes* strains from pure culture with known loci before being applied to clinical samples. The specificity of the assay for each target was tested using other bacterial species including skin commensals and other Propionibacteria.

Assay Validation

A total of 24 sequenced *P. acnes* strains (HL063PA1, HL078PA1, HL083PA1, HL038PA1, HL037PA1, HL082PA1, HL020PA1, HL001PA1, HL046PA2, HL043PA1, HL086PA1, HL110PA3, HL110PA4, HL007PA1, HL087PA3, HL027PA1, HL056PA1, HL067PA1, HL074PA1, HL045PA1, HL053PA1, HL005PA1, HL072PA1, HL043PA2) including possible combinations with and without Locus 1 and Locus 3 were used to validate the triplex qPCR assays. The qPCR triplex assay successfully identified Locus 1 and Locus 3 in strains previously shown by whole genome sequencing to harbor these loci.

Application to Clinical Samples

Genomic DNA extracted from two clinical samples, #1 and #2, were analyzed using the Taqman qPCR triplex assay. Amplification plots revealed the presence of *P. acnes* (Pak) in both samples (FIG. 6). Locus1 and Locus 3 targets were also detected in both samples with a much larger percentage of *P. acnes* Locus1 positive and Locus3 positive strains present in 1 µl of sample #1 compared to sample #2.

Example 5—Acne Vaccine

Strains with 16S rDNA ribotypes (RTs) 4, 5, 7, 8, 9, and 10 were identified as highly associated with acne. Vaccines can be raised against these strains. See T. Nakatsuji et al., 128(10) J. Invest. Dermatol. 2451-2457 (October 2008).

Example 6—Probiotic Development Utilizing the Strains Associated with Healthy Skin in Topical Creams, Solutions, and the Like for Cosmetic and Other Products RT6 is mostly found in healthy skin. These strains can be used as probiotics in topical products for acne prevention and treatment. Four RT6 strains, including HL110PA3, HL110PA4, HL042PA3, and HL202PA1, were isolated and sequenced.

In addition, bacterial culture supernatant and/or cell lysate, including bacterial metabolites, can be used in creams, solutions, and other cosmetic products to prevent the growth of strains associated with acne. Sequences sharing at least 95% homology with SEQ ID NOs 51-54 may be used for the development of probiotics and the like.

Example 7—Drug Development Targeting Specific Strains that are Associated with Acne Identification of the Core and Non-Core Regions of *P. acnes*

The "core" genome regions of *P. acnes* were defined as genome sequences that are present in all of the 82 genomes, while the "non-core" regions were defined as genome sequences that are NOT present in all the genomes. See S. Tomida et al., Pan-genome and Comparative Genome Analyses of *Propionibacterium acnes* Reveal Its Genomic Diversity in the Healthy and Diseased Human Skin Microbiome (in press); see also Example 2. Non-core regions specific to strains of RTs 4 and 5, e.g., loci 1, 2, and 3, were identified, as mentioned previously. Non-core regions specific to strains of RT8 (noted as Locus 4) were also identified as well as several other strains such as HL078PA1, HL030PA2, HL063PA2, P.acn17, HL097PA1, and PRP38. See FIG. 20. The genomic sequence of Locus 4 is set forth as SEQ ID NO:18. The genes in loci 1-4 below (Tables 4-1, 4-2, and 4-3) that are mostly unique to acne associated strains RT4, RT5, and RT8 are listed below. Non-core sequences are also set forth. The genes encoded in these loci are drug targets.

TABLE 4-1

List of genes encoded in loci 1 and 2, specific to RT4 and 5

| Locus in FIG. 3a | ID | Description |
| --- | --- | --- |
| Locus 1 | GM131 | ABC transporter ATP-binding protein |
| Locus 1 | GM132/GM133*[2] | Site-specific recombinase |
| Locus 1 | GM134 | Site-specific recombinase |
| Locus 1 | GM135 | Hypothetical protein |
| Locus 1 | GM136 | Hypothetical protein |
| Locus 1 | GM137 | N-acetylmuramoyl-L-alanine amidase |
| Locus 2 | GM171 | Hypothetical protein |
| Locus 2 | GM172 | Hypothetical protein |
| Locus 2 | GM173 | Single-strand binding family protein |
| Locus 2 | GM174 | CobQ/CobB/MinD/ParA nucleotide binding domain protein |
| Locus 2 | GM175 | Hypothetical protein |
| Locus 2 | GM176 | Hypothetical protein |
| Locus 2 | GM177 | Hypothetical protein |
| Locus 2 | GM178 | Hypothetical protein |
| Locus 2 | GM179 | Hypothetical protein |
| Locus 2 | GM180 | Hypothetical protein |
| Locus 2 | GM181 | CAAX amino protease family protein |
| Locus 2 | GM182 | Hypothetical protein |
| Locus 2 | GM183 | YcaO-like protein |
| Locus 2 | GM184 | Hypothetical protein |
| Locus 2 | GM185 | SagB-type dehydrogenase domain protein |
| Locus 2 | GM186 | Hypothetical protein |
| Locus 2 | GM187 | ABC transporter, ATP-binding protein |
| Locus 2 | GM188 | ABC-2 type transporter |
| Locus 2 | GM189 | Hypothetical protein |
| Locus 2 | GM196 | Hypothetical protein |

TABLE 4-2

List of genes encoded in Locus 3, a linear plasmid and specific to RT4 and 5

| Locus | ID | Description |
| --- | --- | --- |
| Locus 3 | PAGK_2319 | hypothetical protein |
| Locus 3 | PAGK_2320 | hypothetical protein |
| Locus 3 | PAGK_2321 | hypothetical protein |
| Locus 3 | PAGK_2322 | plasmid stabilization system protein |
| Locus 3 | PAGK_2323 | hypothetical protein |
| Locus 3 | PAGK_2324 | hypothetical protein |
| Locus 3 | PAGK_2325 | hypothetical protein |
| Locus 3 | PAGK_2326 | CobQ/CobB/MinD/ParA nucleotide binding domain |
| Locus 3 | PAGK_2327 | hypothetical protein |
| Locus 3 | PAGK_2328 | hypothetical protein |
| Locus 3 | PAGK_2329 | hypothetical protein |
| Locus 3 | PAGK_2330 | hypothetical protein |
| Locus 3 | PAGK_2331 | hypothetical protein (similar to PPA1279) |
| Locus 3 | PAGK_2332 | plasmid partition protein ParA |
| Locus 3 | PAGK_2333 | hypothetical protein |
| Locus 3 | PAGK_2334 | hypothetical protein |
| Locus 3 | PAGK_2335 | hypothetical protein |
| Locus 3 | PAGK_2336 | putatove ribbon-helix-helix protein, copG family |
| Locus 3 | PAGK_2337 | putative ribonuclease E |
| Locus 3 | PAGK_2338 | hypothetical protein (similar to PPA1294) |
| Locus 3 | PAGK_2339 | hypothetical protein (similar to PPA1295) |
| Locus 3 | PAGK_2340 | putative permease |
| Locus 3 | PAGK_2341 | hypothetical protein (similar to PPA1297) |

TABLE 4-2-continued

List of genes encoded in Locus 3, a linear plasmid and specific to RT4 and 5

| Locus | ID | Description |
|---|---|---|
| Locus 3 | PAGK_2342 | hypothetical protein (similar to PPA1298) |
| Locus 3 | PAGK_2343 | hypothetical protein (similar to PPA1299) |
| Locus 3 | PAGK_2344 | hypothetical protein (similar to CLOLEP_00122) |
| Locus 3 | PAGK_2345 | hypothetical protein (similar to CLOLEP_00123) |
| Locus 3 | PAGK_2346 | hypothetical protein (similar to CLOLEP_00124) |
| Locus 3 | PAGK_2347 | hypothetical protein (similar to CLOLEP_00125) |
| Locus 3 | PAGK_2348 | hypothetical protein (similar to CLOLEP_00126) |
| Locus 3 | PAGK_2349 | hypothetical protein (similar to CLOLEP_00127) |
| Locus 3 | PAGK_2350 | hypothetical protein |
| Locus 3 | PAGK_2351 | hypothetical protein (similar to CLOLEP_00129) |
| Locus 3 | PAGK_2352 | hypothetical protein (similar to CLOLEP_00130) |
| Locus 3 | PAGK_2353 | hypothetical protein (similar to CLOLEP_00131) |
| Locus 3 | PAGK_2354 | hypothetical protein (similar to CLOLEP_00132) |
| Locus 3 | PAGK_2355 | hypothetical protein (similar to CLOLEP_00134) |
| Locus 3 | PAGK_2356 | hypothetical protein (similar to CLOLEP_00135) |
| Locus 3 | PAGK_2357 | hypothetical protein (similar to CLOLEP_00141) |
| Locus 3 | PAGK_2358 | hypothetical protein (similar to CLOLEP_00142) |
| Locus 3 | PAGK_2359 | hypothetical protein (similar to CLOLEP_00143) |
| Locus 3 | PAGK_2360 | hypothetical protein (similar to CLOLEP_00144, RcpC) |
| Locus 3 | PAGK_2361 | hypothetical protein (similar to CLOLEP_00145, TadZ) |
| Locus 3 | PAGK_2362 | hypothetical protein (similar to CLOLEP_00146, TadA) |
| Locus 3 | PAGK_2363 | hypothetical protein (similar to CLOLEP_00147, TadB) |
| Locus 3 | PAGK_2364 | hypothetical protein (similar to CLOLEP_00148, TadC) |
| Locus 3 | PAGK_2365 | hypothetical protein (similar to CLOLEP_00149, Flp-1) |
| Locus 3 | PAGK_2366 | hypothetical protein (similar to CLOLEP_00151, TadE) |
| Locus 3 | PAGK_2367 | hypothetical protein (similar to CLOLEP_00152, TadE) |
| Locus 3 | PAGK_2368 | hypothetical protein (similar to CLOLEP_00153, TadE) |
| Locus 3 | PAGK_2369 | hypothetical protein (similar to CLOLEP_00154) |
| Locus 3 | PAGK_2370 | hypothetical protein (similar to CLOLEP_00157) |
| Locus 3 | PAGK_2371 | hypothetical protein (similar to CLOLEP_00158) |
| Locus 3 | PAGK_2372 | hypothetical protein (similar to CLOLEP_00159) |
| Locus 3 | PAGK_2373 | hypothetical protein (similar to CLOLEP_00160) |
| Locus 3 | PAGK_2374 | hypothetical protein |
| Locus 3 | PAGK_2375 | hypothetical protein (similar to CLOLEP_00162) |
| Locus 3 | PAGK_2376 | hypothetical protein (similar to CLOLEP_00163) |
| Locus 3 | PAGK_2377 | hypothetical protein (similar to CLOLEP_00164) |
| Locus 3 | PAGK_2378 | hypothetical protein (similar to CLOLEP_00166) |
| Locus 3 | PAGK_2379 | repA |
| Locus 3 | PAGK_2380 | CobQ/CobB/MinD/ParA nucleotide binding domain |
| Locus 3 | PAGK_2381 | hypothetical protein |
| Locus 3 | PAGK_2382 | hypothetical protein |
| Locus 3 | PAGK_2383 | Yag1E |
| Locus 3 | PAGK_2384 | hypothetical protein |
| Locus 3 | PAGK_2385 | hypothetical protein |
| Locus 3 | PAGK_2386 | hypothetical protein |
| Locus 3 | PAGK_2387 | hypothetical protein |
| Locus 3 | PAGK_2388 | hypothetical protein |
| Locus 3 | PAGK_2389 | hypothetical protein |
| Locus 3 | PAGK_2390 | hypothetical protein |
| Locus 3 | PAGK_2391 | hypothetical protein |
| Locus 3 | PAGK_2392 | ResA |

TABLE 4-3

List of genes encoded in Locus 4, RT8 specific region

| Locus | ID | Description |
|---|---|---|
| Locus 4 | HMPREF9576_00292 | tRNA adenylyltransferase |
| Locus 4 | HMPREF9576_00293 | conserved hypothetical protein |
| Locus 4 | HMPREF9576_00294 | conserved domain protein |
| Locus 4 | HMPREF9576_00295 | response regulator receiver domain protein |
| Locus 4 | HMPREF9576_00296 | histidine kinase |
| Locus 4 | HMPREF9576_00297 | hypothetical protein |
| Locus 4 | HMPREF9576_00298 | hypothetical protein |
| Locus 4 | HMPREF9576_00299 | hypothetical protein |
| Locus 4 | HMPREF9576_00300 | hypothetical protein |
| Locus 4 | HMPREF9576_00301 | hypothetical protein |
| Locus 4 | HMPREF9576_00302 | drug resistance MFS transporter, drug:H+ antiporter-2 (14 Spanner) (DHA2) family protein |
| Locus 4 | HMPREF9576_00303 | hypothetical protein |
| Locus 4 | HMPREF9576_00304 | conserved domain protein |
| Locus 4 | HMPREF9576_00305 | beta-ketoacyl synthase, N-terminal domain protein |
| Locus 4 | HMPREF9576_00306 | hypothetical protein |
| Locus 4 | HMPREF9576_00307 | acetyltransferase, GNAT family |
| Locus 4 | HMPREF9576_00308 | putative (3R)-hydroxymyristoyl-ACP dehydratase |
| Locus 4 | HMPREF9576_00309 | putative acyl carrier protein |
| Locus 4 | HMPREF9576_00310 | putative 3-ketoacyl-(acyl-carrier-protein) reductase |
| Locus 4 | HMPREF9576_00311 | ornithine cyclodeaminase/mu-crystallin family protein |
| Locus 4 | HMPREF9576_00312 | pyridoxal-phosphate dependent enzyme |
| Locus 4 | HMPREF9576_00313 | lantibiotic dehydratase, C-terminus |

TABLE 4-3-continued

List of genes encoded in Locus 4, RT8 specific region

| Locus | ID | Description |
|---|---|---|
| Locus 4 | HMPREF9576_00314 | aminotransferase, class I/II |
| Locus 4 | HMPREF9576_00315 | acyl carrier domain protein |
| Locus 4 | HMPREF9576_00316 | AMP-binding enzyme |
| Locus 4 | HMPREF9576_00317 | malonyl CoA-acyl carrier protein transacylase family protein |
| Locus 4 | HMPREF9576_00318 | ABC-2 type transporter |
| Locus 4 | HMPREF9576_00319 | ABC transporter, ATP-binding protein |
| Locus 4 | HMPREF9576_00320 | hypothetical protein |

Example 8—Targeted Phage Therapy

Bacteriophages play an important role in regulating the composition and dynamics of microbial communities, including the human skin microbiota. Bacteriophages of *Propionibacterium acnes*, a major skin commensal, were previously isolated and used as a typing system to distinguish different serotypes of *P. acnes*. However, molecular characterization of these phages had been lacking. Recent efforts in genome sequencing have improved our understanding of *P. acnes* phages and their interactions with bacterial hosts.

Bacteriophages are the most abundant organisms on earth (Mc Grath & van Sinderen, 2007) and are believed to outnumber bacteria by 10:1 in many diverse ecosystems (Rohwer, 2003). As important components of microbial communities, bacteriophages are a reservoir of diversity-generating elements (Rohwer & Thurber, 2009) and regulate both the abundances (Suttle, Chan, & Cottrell, 1990) and diversity of microbial hosts by predation (Rodriguez-Valera et al., 2009). The human skin is inhabited by hundreds of microbial species, including bacteria, fungi, and viruses (Grice & Segre, 2011). The homeostasis of this ecosystem is important to its function as a barrier against the invasion and colonization of pathogens on the skin. However, much remains to be learned about the nature and driving forces of the dynamics among the microorganisms in the skin microbial community. In particular, the relative abundances and interactions between bacteriophages and their bacterial hosts on the skin remained to be elucidated.

The microbial community in the pilosebaceous unit of the skin is dominated by *Propionibacterium acnes*, which accounts for approximately 90% of the microbiota ("(Nature Precedings Paper)," n.d.). *P. acnes* has been suggested as a pathogenic factor in the development of acne vulgaris (Bojar & Holland, 2004; Leyden, 2001), one of the most common human skin diseases. Above-detailed studies classified *P. acnes* strains into ribotypes (RT) based on their 16S ribosomal RNA (rRNA) sequences, and demonstrated that *P. acnes* strain population structure in pilosebaceous units differs between healthy skin and acne affected skin.

*P. acnes* bacteriophages exist on the human skin. In 1968, Zierdt et al. (Zierdt, Webster, & Rude, 1968) isolated such a phage, named phage 174, from spontaneous plaques of a *P. acnes* isolate (at the time known as *Corynebacterium acnes*). Phage 174 was able to lyse nearly all *P. acnes* strains tested in the study [10]. Subsequently, more *P. acnes* phages were isolated which exhibited varied life cycles that range from lytic to temperate [11, 12]. However, in the last decades, the study of *P. acnes* bacteriophages had been limited to the development of phage typing systems to distinguish the different serotypes of *P. acnes* [13, 14]_EN-REF_4, and extensive molecular characterization of the phages has been lacking.

Recent genomic sequencing of *P. acnes* bacteriophages (Farrar et al., 2007; Lood & Collin, 2011; Marinelli et al., 2012) have provided new insight into *P. acnes* phage diversity. *P. acnes* phages are similar to mycobacteriophages both morphologically and genetically, but have a much smaller genome. Currently 14 phage genome sequences are available. Sequencing additional phage isolates is needed to further characterize the diversity. Despite these recent sequencing efforts, the genome-level diversity of *P. acnes* phages in the human skin microbiome and their interactions with *P. acnes* and other Propionibacteria remain to be elucidated. *P. acnes* phages have diverse host specificities among different lineages of *P. acnes* strains [14]. Phage host specificity is important in determining how these phages regulate the composition and dynamics of *P. acnes* populations in the community. On the other hand, certain *P. acnes* strains may also influence phage populations through their anti-viral mechanisms, such as the bacterial immune system based on the transcription of clustered, regularly-interspaced short, palindromic repeat (CRISPR) sequence arrays. The CRISPR arrays contain oligonucleotide 'spacers' derived from phage DNA or plasmid DNA. In a manner analogous to RNA interference, the transcribed, single-stranded CRISPR RNA elements interact with CRISPR-associated (Cas) proteins to direct the degradation of DNA targets containing complementary 'protospacer' sequences from foreign DNA [16]. While characterizing the genome diversity of *P. acnes*, Applicants discovered that *P. acnes* strains of RT2 and RT6 harbor CRISPR arrays. The CRISPR mechanism may play a role in defending against phage or plasmid invasion.

To better understand the interactions between bacteria and bacteriophages in the human skin microbiome and their contributions to skin health and disease, the diversity and host specificity of *P. acnes* phages isolated from acne patients and healthy individuals was investigated. The genomes of 15 phage isolates were investigated and screened against a panel of 69 sequenced Propionibacteria strains to determine their host range and specificity.

Phage Isolation and General Genome Features

To characterize the genetic diversity and the abundance of *P. acnes* phages in the skin microbiome, 203 skin samples of pilosebaceous units from 179 individuals were collected, including 109 samples from normal individuals and 94 from acne patients. All of the samples were cultured for *P. acnes* under anaerobic conditions. Phage plaques in 49 samples were observed: 35 from normal individuals and 14 from acne patients. *P. acnes* phages were found more frequently in samples from normal individuals than from acne patients with statistical significance (p=0.005, Fisher's exact test). Among the 93 phage isolates that were obtained from these samples, five phages from acne patients and ten from normal individuals were selected for whole genome sequencing using 454 or Illumina platforms (Table 3-1).

TABLE 3-1

Phage Genome Information and Sequencing Statistics

| Phage Name | Genome Length (bp) | GC % | Total Input Reads | Total Input Bases | Coverage | Annotated ORFs | Presence of II-xx Overhang |
|---|---|---|---|---|---|---|---|
| PHL111M01 | 29,140 | 54.33 | 5,453 | 2,865,116 | 98x | 46 | yes |
| PHL060L00 | 29,514 | 54.05 | 10,000 | 12,015,904 | 407x | 47 | yes |
| PHL112N00 | 29,266 | 54.48 | 10,000 | 12,270,460 | 419x | 47 | yes |
| PHL113M01 | 29,200 | 54.10 | 4,228 | 2,237,790 | 77x | 45 | yes |
| PHL114L00 | 29,464 | 54.21 | 10,000 | 12,270,608 | 416x | 47 | yes |
| PHL010M04 | 29,511 | 53.99 | 3,185 | 1,686,535 | 57x | 46 | not verified |
| PHL066M04 | 29,512 | 53.99 | 4,478 | 2,364,379 | 80x | 46 | yes |
| PHL073M02 | 29,503 | 53.99 | 4,700 | 2,529,669 | 86x | 46 | not verified |
| PHL071N05 | 29,467 | 53.92 | 6,143 | 3,059,098 | 104x | 46 | not verified |
| PHL067M10 | 29,377 | 54.26 | 4,486 | 2,313,471 | 79x | 46 | yes |
| PHL115M02 | 29,453 | 53.82 | 8,914 | 4,687,391 | 159x | 46 | yes |
| PHL085M01 | 29,451 | 53.82 | 10,000 | 12,552,610 | 426x | 46 | yes |
| PHL037M02 | 29,443 | 53.78 | 5,895 | 3,093,818 | 105x | 46 | yes |
| PHL085N00* | 29,454 | 53.83 | 20,000 | 3,904,239 | 133 | 45 | yes |
| PHL082M00* | 29,491 | 54.38 | 20,000 | 3,289,741 | 112 | 44 | yes |
| Average | 29,383 | 54.05 | 6,729 | 5,688,219 | 193.37 | 46 | |

Figure 29:
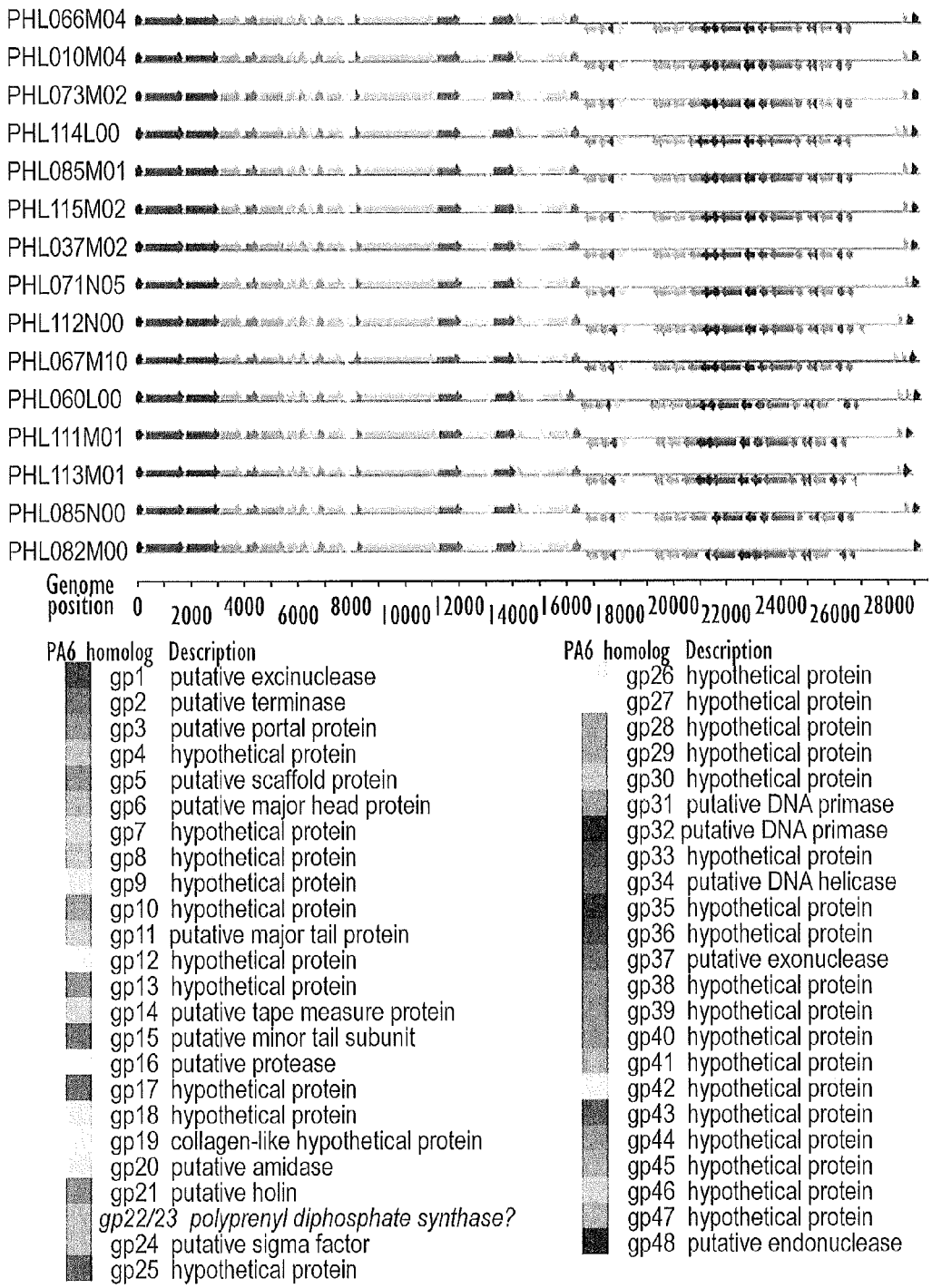
FIG. 29 provides *P. acnes* phage genomes and annotations. Genome organizations of all 15 phages are shown. Hatched arrows in previously published genomes represent newly annotated ORFs proposed. Italicized legend entries refer to newly-annotated or revised ORFs.

*sequenced on the Illumina MiSeq platform. All other genomes were sequenced on the 454 platform All phage genomes were assembled, completed, and annotated (FIG. 29). The genomes of these 15 phages have comparable sizes (29.1-29.5 Kb) and GC content (53.8-54.5%), similar to the published P. acne phage genomes. On average, 44 open reading frames (ORFs) were predicted in each genome. Consistent with the genome organization previously reported [11, 15], the ORFs were arranged compactly within the left and right arm regions of each genome. The left arm and right arm of the genomes can be distinguished by their opposite directions of transcription. The sequence identity between any pair of genomes is moderately high, ranging from 78.2 to 99.9% (Table 3-1).

Figure 30:
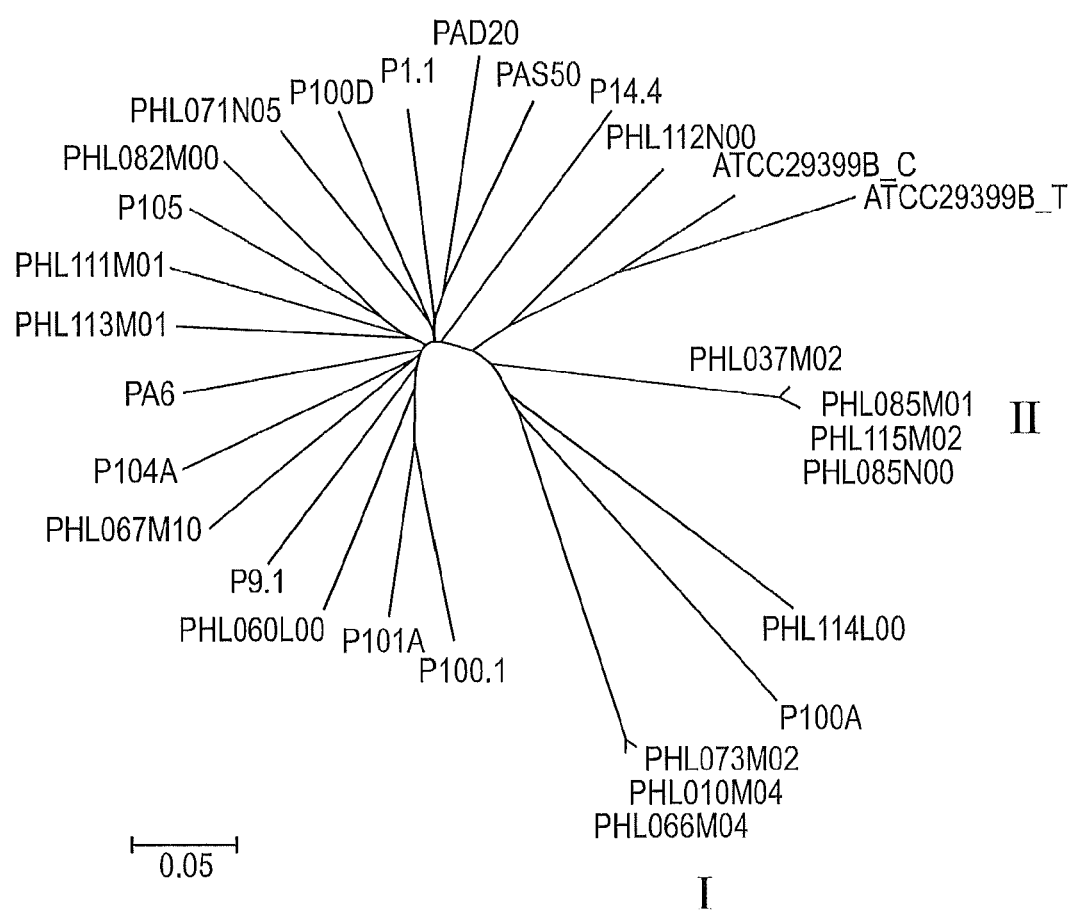
FIG. 30 provides a phylogenetic tree of 29 sequenced phage genomes constructed based upon the 6,148 SNPs in the core regions. Branches with bootstrap values less than 80 (based on 200 resamplings) were collapsed.
Figure 31:
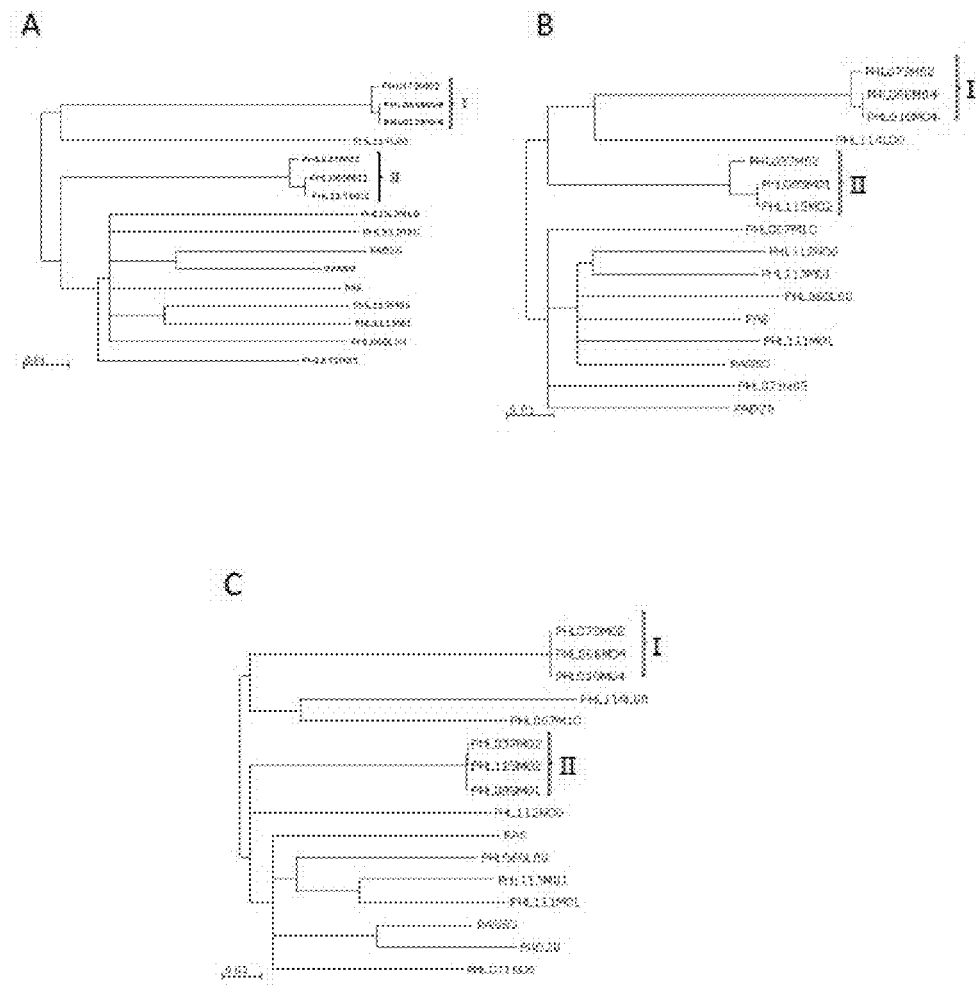
FIG. 31 provides phylogentic trees based on the genome sequences. (A) provides a phylogenetic tree constructed based on the entire genome sequences of all 16 phages. With the exception of PHL112N00, the phylogenetic relationships among the phages remain the same as using the core regions only, shown in FIG. 30. (B) shows the phylogenetic tree that was constructed using only the left-arm of the genomes, which are highly conserved among the phages. (C) shows the phylogenetic tree that was constructed using only the right-arm coding regions. Groups I and II from FIG. 30 are also indicated in the trees. Branches with bootstrap values less than 80 (based on 5,000 resamplings) were collapsed.

P. acnes Phages are Diverse with Subgroups of Highly Related Strains with Distinct Sites of Genetic Variations To investigate the genome diversity of P. acnes phages, all 29 sequenced phage genomes were compared, including Applicants' 15 phage genomes and the 14 published ones (Farrar et al., 2007; Lood & Collin, 2011; Marinelli et al., 2012). The core genomic regions shared by all 29 genomes have a combined length of 24,475 bp (83% of the average genome length) and contain 6,812 single-nucleotide polymorphisms (SNPs). A phylogenetic tree constructed from these 6,812 SNPs (FIG. 30) shows that most of the phage genomes isolated from all studies to date show comparable divergence from each other with an average distance of 0.301 (substitution rate at the SNP sites). However, also found were two groups of phages, named as Group I and Group II (FIG. 30), that are closely related with much shorter phylogenetic distances. The same results were obtained when the entire genome sequences (including core and non-core regions) were used in the calculation of phylogenetic relationships (FIG. 31).

Figure 32:
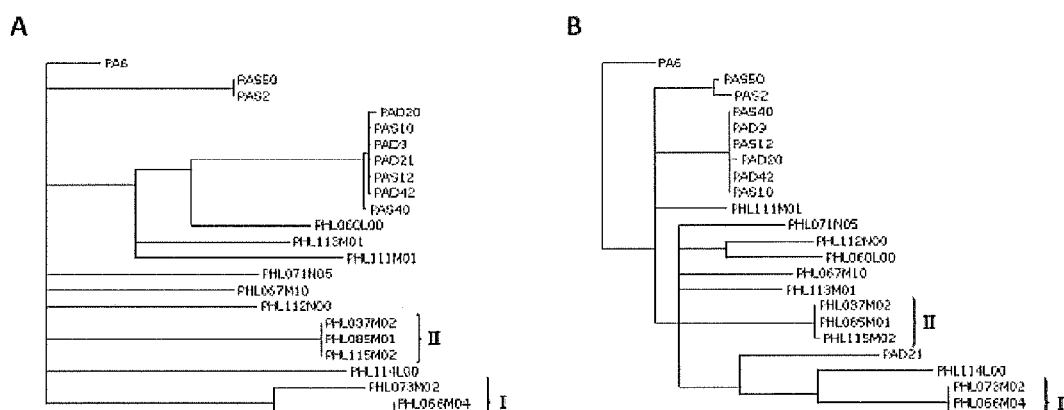
FIG. 32 shows the phylogentic trees constructed based upon the nucleotide sequences of amidase (A) and head protein (B) from all phages, including the sequences from Lood et al. The phylogenetic relationships among the phages from the previous study remain the same in these trees. Groups I and II remain the same as in the genome shown in FIG. 30.

We next determined whether the newly-sequenced phages belong to the phylogenetic groups discovered before. Lood et al. previously surveyed the phylogenetic diversity of P. acnes phages based on the nucleotide sequences encoding head proteins or amidases of phage isolates [12]. Three major phylogenetic groups were reported. Applicants' data were combined with the data from Lood et al. and Applicants reconstructed the phylogenetic trees of head protein and amidase gene sequences. The updated phylogenetic trees reproduced the relationships among the strains from the previous study (FIG. 32). However, Applicants' phages were grouped into separate clades. Moreover, by including the gene sequences from the current study, the longest phylogenetic distance among all studied phages was increased from 0.077 to 0.102 for the head protein gene and from 0.140 to 0.182 for the amidase gene. Although these distances are still considerably shorter than those of the closest outgroups (0.939, head protein from mycobacteriophage Che9d; 0.764, P. acnes KPA171202 amidase) [12], the analysis suggests that P. acnes phage diversity is broader than previously described.

Some of the P. acnes phages appear to be closely related strains as previously shown [12]. Among the 29 sequenced genomes, two groups of closely related strains were observed (FIG. 30). Group I consists of PHL066M04, PHL010M04, and PHL073M02, which are separated by an average phylogenetic distance of 0.002 at the genome level. Group II consists of PHL085M01, PHL085N00, PHL115M02, and PHL037M02, with an average phylogenetic distance of 0.004. These two groups are statistically robust when core regions or the entire genome or only the left-arm or rightarm coding regions were used in calculating the phylogeny (FIGS. 30 and 31).

Whether the genetic variations among Group I phages or Group II phages were located in particular regions of the genomes was investigated. The sites of sequence variation among Group I phages lie primarily within the region encoding a putataive type II holin and a peptidoglycan amidase (Gp20 and Gp21 as annotated in PA6, FIG. 33). These endolysins permeabilize the membrane and degrade the extracellular peptidoglycan layer to release new phage particles from the bacterial host. The majority of the sequence variations in these two genes among the Group I phage genomes are mostly synonymous and do not appear to affect the functions of the proteins. The genomes of PHL010M02 and PHL066M02 differ at only 11 sites, 9 of which occur in predicted coding regions.

Figure 33:
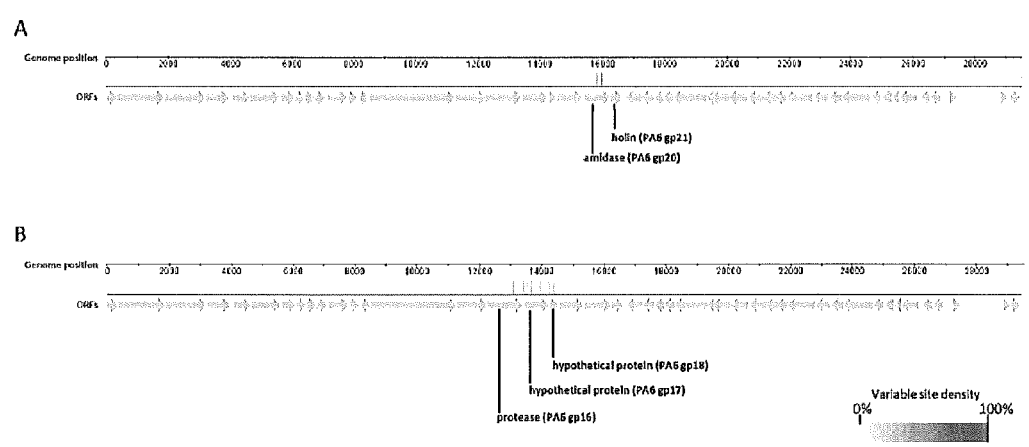
FIG. 33 reflects multiple alignments generated for genomes from Groups I and II of closely-related phages. Sites of nucleotide variations are mapped to a member from each group. The density of variable sites in each 50-nt window of the genome is indicated in red, with 100% density indicating that all 50 sites in the window vary between the group members. (A) provides variations among Group I phages (PHL010M04, PHL066M04, PHL073M02) mapped to the PHL010M04 genome. (B) provides variation among Group II phages (PHL115M02, PHL085M01, PHL085N00, PHL037M02) mapped to the PHL115M02 genome. Gray arrows represent ORFs in each genome.

Genetic variations among Group II members reside in a region encoding homologs of Gp16, Gp17, and Gp18 in PA6 (FIG. 33). These proteins' location near the 3' end of the left arm between structural proteins and lysis proteins suggests that they may be late-acting genes involved in viral protein processing and packaging.

Alternative Annotations of *P. acnes* Phage Genomes

The large number of newly-sequenced *P. acnes* phage strains provided an opportunity to validate and refine initial annotations of the *P. acnes* phage genomes. Based on the analysis, several alternative annotations of the phage genomes were confirmed.

All 15 phage genomes that were sequenced support an alternative annotation of the Gp22/23 locus, which was previously annotated as two ORFs, Gp22 and Gp23, encoded on the plus-strand in the PA6 genome. Homologs of the PA6 genes Gp22 and Gp23 were not consistently identified in the genomes, as many of the homologs have inconsistent start and stop codon positions at the expected plus-strand locations of these genes. However, on the minus-strand, all genomes appear to encode a single ORF with a length of 513-522 bp. This annotation is consistent with the annotation reported by Marinelli et al. (Marinelli et al., 2012), which is referred to herein as Gp22/23 (FIG. 29). While no known function was assigned to Gp22 or Gp23 of the original plus-strand annotation, the minus-strand annotation of Gp22/23 in PHL112N00 and PHL111M01 showed modest similarity to a zinc finger protein from *Arthroderma gypseum* (E-values 1.0e-4 and 5.7e-4, respectively). The PHL111M01 annotation also showed similarity to a polyprenyl diphosphate synthase from *Streptomyces albus* (E-value 2.6e-5) and a polyketide synthase from the *Frankia* genus (E-value 2.5e-4). The minus-strand Gp22/23 ORFs from most genomes are homologs of each other, except those in PHL067M10 and PHL114L00. The Gp22/23 ORFs in these two genomes form a separate group and share little nucleotide similarity to the other Gp22/23 ORFs despite being present at the same locus in the genome. The observation that this ORF appears in all the phage genomes on the minus strand suggests that this region may be part of the right arm. This is consistent with previous reports of a plus-strand transcriptional terminator that separates Gp22/23 from the rest of the left arm in PA6, PAD20, and PAS50 [11].

Homologs of the PA6 ORFs Gp42, Gp45, and Gp46, which occur in the right-arm of the genome near the ~1 kb non-coding region, were not consistently identified. The expected locations of each of these right-arm ORFs in the phage genomes frequently contained numerous stop codons and showed limited homology to corresponding regions of the PA6 genome. This is consistent with the generally high degree of nucleotide variation near the non-coding region and suggests that these ORFs may represent genes that are differentially present among different phage strains.

The sequencing data demonstrated that the ends of the phage genomes are flanked by 11-nucleotide single-stranded overhangs (Table 3-1). In the sequencing data of 10 phage genomes, 1-3 reads that span both the 3' and 5' ends of the genomes were found. The genome ends in these reads are consistently separated by a sequence that matches the 11-nt single-stranded extension previously reported (Marinelli et al., 2012). However, based on the sequencing data, the presence of overhangs in three of the 15 genomes: PHL010M04, PHL073M02, and PHL071N05, were not shown. It is possible that they were simply not detected, as overhang-containing reads were rarely observed in general (2.3 overhang reads per 10,000 reads). Nevertheless, the data do suggest that the phage DNA could be circularized at some point in their life cycle, as previously proposed [11]. The absence of the overhang sequence in reads that map to only one end of the genome may be an artifact of sample processing, as T4 DNA polymerase is used to 'polish' fragmented library DNA by digesting 3' single-strand extensions and extending the complement of 5' single-strand extensions (Roche Diagnostics, 2009). If so, it is surmisable that the overhang may exist on the 3' ends of the genome.

Host Range and Specificity of *P. acnes* Phages

To investigate the host range and specificity of *P. acnes* phages, the 15 sequenced phages were screened against a panel of 69 *Propionibacterium* strains, including 65 *P. acnes* strains, three *P. humerusii* strains, and one *P. granulosum* strain. Except for the *P. acnes* strains KPA171202 and ATCC11828, all of these *Propionibacterium* strains were isolated from the same cohort of subjects sampled for phages. The genomes of all 65 *P. acnes* strains and three *P. humerusii* strains were sequenced. A phylogenetic tree of the 65 *P. acnes* strains based on the SNPs in their core genomic regions was constructed (FIG. 33, left dendrogram). Based on the previously established typing of *P. acnes* strains by their RecA gene sequences [7], the bacterial collection included all major lineages of *P. acnes* found on the human skin, with multiple strains representing each type: IA-1, IA-2, IB-1, IB-2, IB-3 and II. The susceptibility/resistance of each of the 69 bacterial strains against each of our 15 sequenced phages was determined using a crossstreak method. In total, 1,035 bacterium-phage interactions were determined. Each experiment was repeated at least five times. For the bacterial strains that showed resistance to phages, the fold changes in efficiency of plaquing (EOP) was determined relative to the *P. acnes* strain ATCC6919, which is known to be susceptible to all tested strains.

Figure 34:
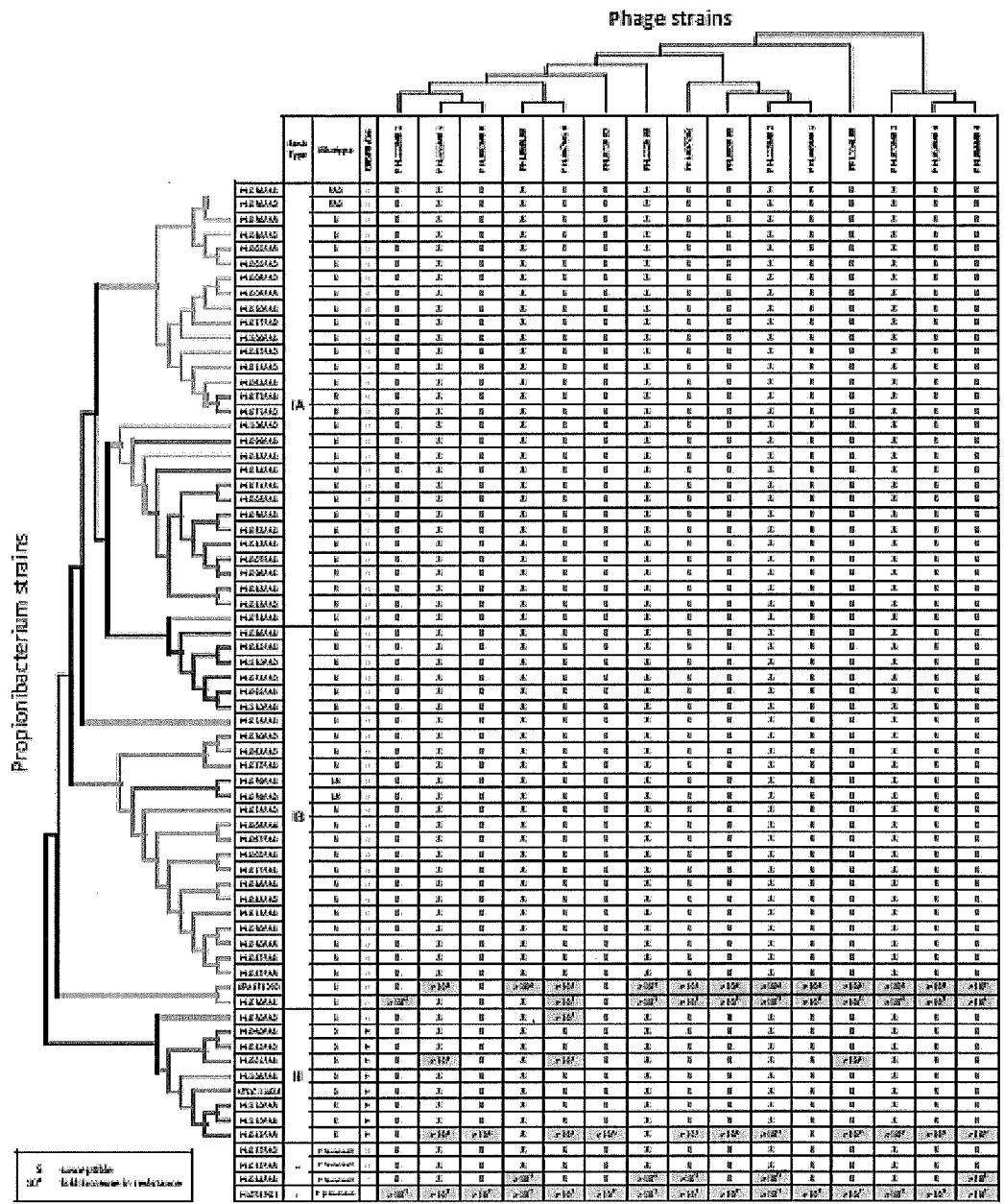
FIG. 34 shows host range and specificity of *P. acnes* phages. The susceptibility/resistance of 66 *P. acnes* strains, three *P. humerusii* strains, and one *P. granulosum* strain against 15 newly sequenced phages is shown. Dendrograms on the top and to the left represent the respective phylogenetic trees of the phages and *P. acnes* strains (only topology is shown). "S" indicates that the tested *Propionibacterium* strain was susceptible to the tested phage. Numbers in red represent the fold increase in resistance of the Propionibacteria strains against phages relative to *P. acnes* strain ATCC6919.

It was found that the susceptibility/resistance to phage is correlated with the *P. acnes* lineages. Five of the 69 *Propionibacterium* strains showed a 100-fold or greater increase in resistance against at least one phage. *P. acnes* strains of types IA-1, IA-2, IB-1, and IB-2 were all susceptible to all tested phages. However, two strains of type IB-3 (KPA171202 and HL030PA1) were highly resistant to some of the phages (FIG. 34). Type IB-3 strains encode components of a type III restriction modification system (genes PPA1611 and PPA1612 in KPA171202). This may explain their resistance to phages. KPA171202 encodes a cryptic prophage in the genome [17]. However, the sequence of the prophage is not related to any of the sequenced *P. acnes* phages, therefore, the presence of the cryptic prophage is unlikely to explain the resistance to phages. Three type II strains were also highly resistant to some of the phages. This is consistent with previous observations that strains of this type were more frequently resistant to phages [14].

On the other hand, the susceptibility/resistance of *P. acnes* strains to phages did not correlate with phage lineages (r=0.1343, p-value=0.115, Mantel test). Even the host ranges among closely-related phage strains in Group I or Group II are different (FIG. 34). One example is PHL066M04, a Group I phage that showed little similarity to other phages in the same group, but had a similar bacterium-phage interaction pattern to the Group II phages PHL115M02 and PHL037M02. These results suggest that bacterial factors may play an important role in determining the phage host range and specificity.

To determine whether these phages are specific to only *P. acnes* or if they are capable of interacting with other Propionibacteria, included were one *P. granulosum* strain and three *P. humerusii* strains in the bacterium-phage interaction experiment. *P. granulosum* is a common skin commensal with approximately 1.1% abundance in the pilosebaceous unit [7]. *P. humerusii* is a newly-defined species [18]. In the study cohort, *P. humerusii* is one of the major species found on the skin with an abundance of 1.9% in the pilosebaceous unit [7]. It is closely related to *P. acnes* with >98% identity in the 16S rRNA gene sequence [18]. While the *P. granulosum* strain showed strong resistance to all the phages tested, two *P. humerusii* strains, HL037PA2 and HL037PA3, were susceptible to all the phages. The third *P. humerusii* strain, HL044PA1, was lysed by ten of the 15 phages tested. This suggests that the host range of *P. acnes* phages is not limited to *P. acnes* but also includes *P. humerusii* and possibly other closely-related *Propionibacterium* species.

Resistance to Bacteriophages does not Correlate with the Presence of Matching CRISPR Spacers in *P. acnes* Strains Among the 65 *P. acnes* isolates, eight strains belong to RT2 and RT6 (RecA type II) and encode CRISPR/Cas genes, which function as a bacterial adaptive immune mechanism against foreign DNA. These RT2 and RT6 strains each have one to nine spacers, 33 nucleotides long, in their CRISPR arrays. In total, they encode 42 spacers, 28 of which are unique.

Figure 35:
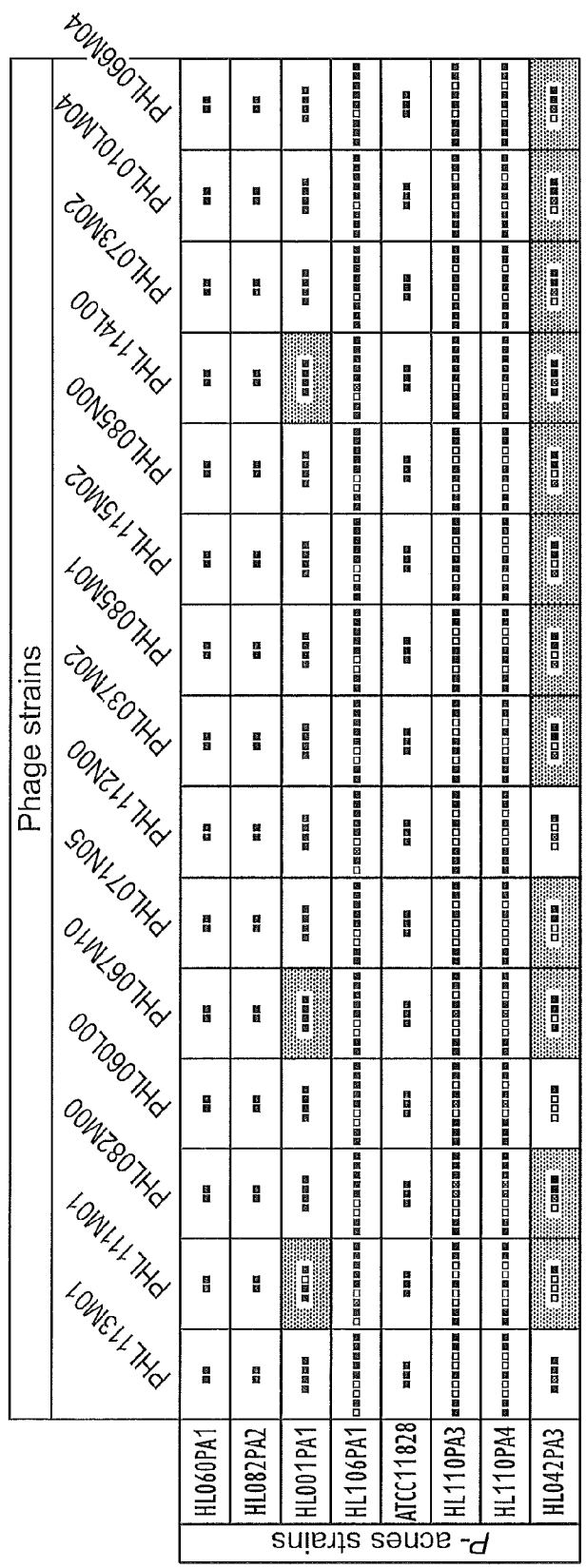
FIG. 35 provides a correlation between *P. acnes* resistance to phages and the presence of matched CRISPR spacers. The colored pixels in each cell represent the CRISPR spacers encoded in each *P. acnes* strain (shown in rows). Each red pixel means that this spacer has an exact protospacer match in the corresponding phage (shown in columns). Each orange pixel means that this spacer has a partially matched protospacer (one to two mismatches) in the corresponding phage. Gray pixels mean no matched protospacers. Pink cells indicate the bacterial resistance to the phages.
Figure 36:
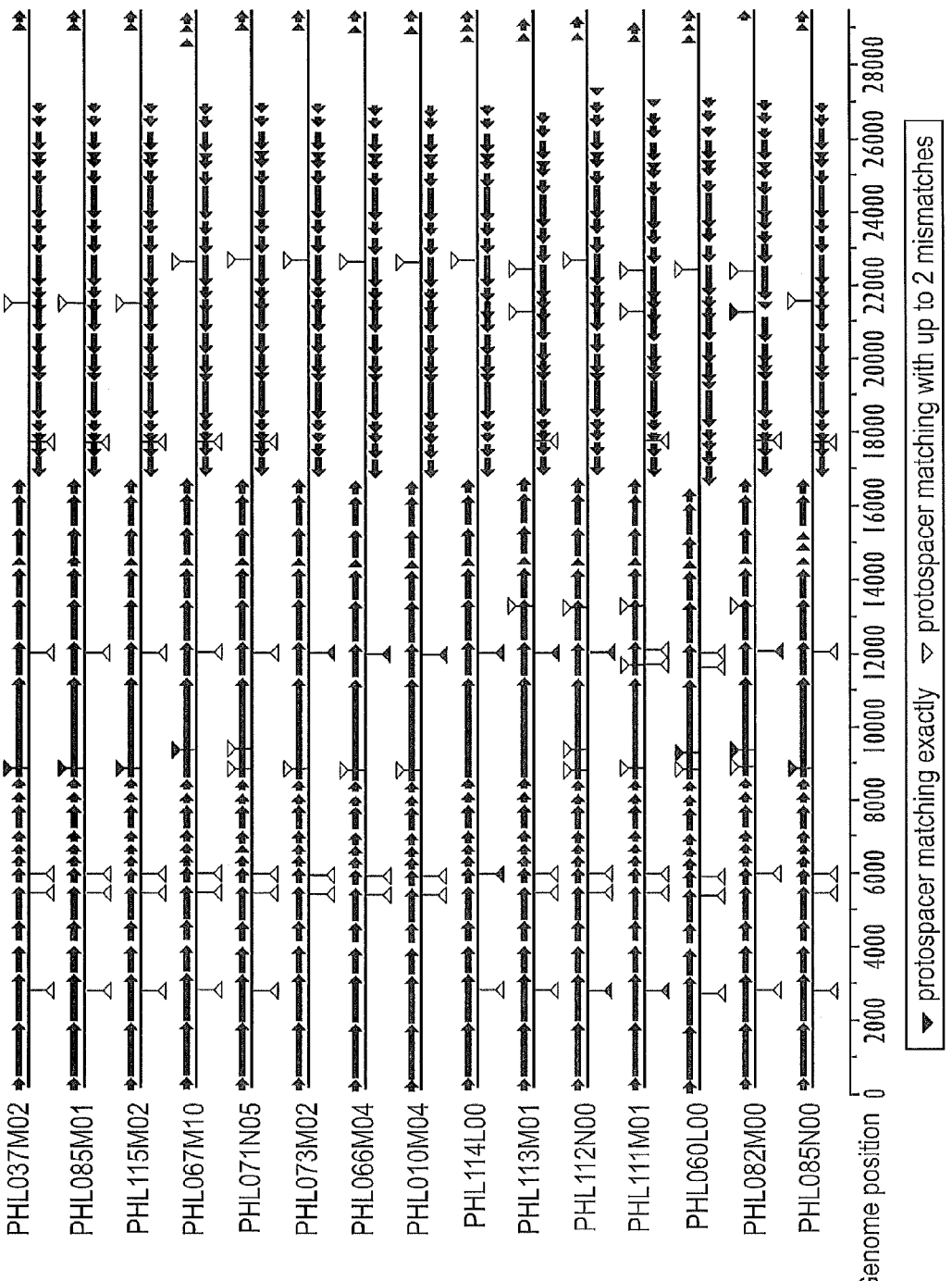
FIG. 36 reflects that each of the 15 sequenced phages was aligned to all 8 CRISPR spacer arrays identified in the *P. acnes* strains to identify protospacer sequences in each phage genome that have an exact match (red) or up to two mismatches (orange). Plus- and minus-strand protospacers are shown above and below the genomes, respectively.

Whether the CRISPR/Cas mechanism can explain phage susceptibility/resistance in the RT2 and RT6 strains was investigated. Protospacers in the 15 phage genomes that match a spacer sequence from the RT2 and RT6 *P. acnes* strains were identified. Up to two mismatches were allowed in the sequence alignments. In all phages, protospacers that match the spacers in at least two *P. acnes* strains were identified (FIG. 35). These protospacers are all single-copied in the phage genomes and are located primarily on the left arm (FIG. 36). Their locations are generally conserved among all other phage genomes harboring the same protospacer sequences.

The susceptibility/resistance patterns of the eight RT2 and RT6 *P. acnes* strains showed little correlation with either the number of spacers in each array that had protospacer matches (r=0.207) or whether at least one match could be found against the CRISPR array in general (r=0.202). Susceptibility/resistance to phages also did not correlate with the pattern with which any specific spacer matched (maximum absolute correlation 0.051).

Phages can escape the CRISPR defense mechanism by mutating sites involved in protospacer recognition. The short nucleotide motif downstream of the protospacer, known as the protospacer-adjacent motif (PAM), is highly conserved among targets of CRISPR/Cas systems [19]. Mutations in these nucleotides have been found to disrupt CRISPR-mediated resistance despite complete complementarity in the protospacer sequence [20-22]. To determine whether the lack of correlation between bacterial susceptibility/resistance and the presence of matching spacer sequences is due to mutations within the PAM sequence, the PAMs of the nine protospacers that have exact matches to the spacer sequences encoded in HL042PA3 were examined. Six of these protospacers come from phages that HL042PA3 was resistant to, while the other three protospacers are from the phages that were able to lyse HL042PA3. Among the six protospacers, sequence conservation at several sites within their 33-nucleotide length and within the ten downstream nucleotides expected to contain the PAMs were observed (FIG. 37). This suggests that these protospacer motifs are conserved and can be targeted by HL042PA3 CRISPRs. However, these same nucleotide positions are also conserved in the three protospacers from other phages (PHL113M01, PHL112N00, and PHL085M01) that were able to lyse HL042PA3 (FIG. 37). Thus, the conservation of protospacer motifs including the PAMs cannot explain the lack of correlation between bacterial susceptibility/resistance and the presence of matching spacer sequences In summary, the data demonstrate that encoding CRISPR spacers that match against the genome of an invading phage is not sufficient for an effective defense, suggesting that transcriptional and/or translational regulation of CRISPR RNA and Cas gene expression may also be required for CRISPR-mediated resistance. Interactions between these bacteria and phages may also depend on additional phage and bacterial components involved in phage binding, entry, replication, or release.

A diverse group of *P. acnes* bacteriophages that reside on the human skin has been revealed. Most of the sequenced phages show moderately high genetic similarity with certain strains forming closely-related groups. These phages show various patterns of interaction with *P. acnes* and *P. humerusii* strains, but these patterns do not correlate with phage phylogeny. It was determined that resistance or susceptibility to phages correlated well with *P. acnes* lineages. Types IA-1, IA-2, IB-1, and IB-2 were all susceptible to all tested phages, while certain strains of types IB-3 and II were resistant to some phages. Phage resistance in type II *P. acnes* strains does not correlate with the presence of CRISPR spacers that match to phage protospacers, suggesting that additional mechanisms, such as regulation of the CRISPR/Cas system and/or other antiviral mechanisms, are needed in conferring the phage resistance.

This study suggests an important regulatory role of *P. acnes* bacteriophages in the skin microbiome. The strain-specific host ranges demonstrate the ability of these phages to regulate particular subsets of the *P. acnes* population and *P. humerusii* population. Among these subsets of *Propionibacterium* populations, phages may also disseminate genes that potentially modify virulence, as suggested by Lood and Collin [11], or competitiveness, as it was suggested that gp22/23 encoded in some phages may be potentially involved in the production of polyketide antimicrobials. Both the selective lysis and modification of *P. acnes* strains by phages potentially regulates the relative abundances of the commensal and pathogenic strains of *P. acnes* on the skin. This delicate balance between commensals and pathogens can be especially important for skin health and disease at sites where *P. acnes* dominates. Based on the metagenomic shotgun sequencing data, it is estimated that the ratio between *P. acnes* phage and *P. acnes* in the pilosebaceous unit is 1:20 [7], which is far different from the phage:bacteria ratios estimated in environmental microbial communities, where viruses typically outnumber bacteria [23]. This suggests that the human host also plays a role in selecting and regulating the composition and diversity of the microbiome.

Materials and Methods

Propionibacteria Culture

*P. acnes*, *P. humerusii*, and *P. granulosum* strains were cultured under anaerobic conditions in Clostridial media (Oxoid) at 37° C. for 4-6 days. *Propionibacterium* cultures were used to prepare top agar overlays for phage culture on A media plates (12 g/L pancreatic digest of casein, 12 g/L Difco yeast extract, 22.2 mM D-glucose, 29.4 mM g/L potassium phosphate monobasic, 8 mM magnesium sulphate heptahydrate, 20 g/L Difco agar).

Phage Isolation and DNA Extraction

Plaques found on skin sample culture plates were isolated by puncturing the agar with a pipet tip and resuspending in 50 µL SM buffer (0.1 M sodium chloride, 8 mM magnesium sulfate heptahydrate, 1M Tris-HCl, pH 7.5, 2% gelatin, 1 mM calcium chloride). The phage resuspension was spread onto A media plates with top agar containing *P. acnes* strain ATCC 6919. After incubation at 37° C. for 2 days, phages were eluted with 8 mL SM buffer at room temperature, filtered with 0.22 uM PES filter (Millipore), and stored at 4° C. Phage titers were determined by plaque assay.

Phage DNA extraction was performed using the Lambda Mini Kit (Qiagen) with the following modifications. Phage particles were precipitated in Buffer L2 by centrifugation at 20,000 g for 1 hour. Extracted DNA was eluted with Buffer QF and precipitated with isopropanol overnight at −20° C. before centrifugation.

Phage Genome Sequencing and Annotation

Phage genomes were sequenced in multiplex using the Roche GS FLX Titanium or Illumina MiSeq platforms. De novo assembly of reads was performed with MIRA [24], and the resulting contigs were manually finished in Consed [25]. For phages covered by more than 20,000 reads, assembly was performed on a randomly-selected subset of 10,000 reads for 454 data or 20,000 reads for MiSeq data. Fully assembled phage genomes were annotated using Genemark.hmm [26] and Glimmer v3.02 [27].

Genome Sequence Alignment and Phylogenetic Tree Construction

Sequences present in all 16 phage genomes were defined as core regions of the phage genome. To identify these core regions, alignments were first generated between the PA6 genome and each of the other 15 phage genomes using Nucmer [28]. This yielded 15 sets of starting and ending coordinates describing intervals within the PA6 genome that align with any given phage genome. The core regions were then calculated for all phages by determining the overlapping intervals between all of the 15 coordinate sets. The core region sequences were concatenated for the subsequent multiple sequence alignments. Single nucleotide polymorphisms (SNPs) on the core regions were identified by using the "show-snps" option of Nucmer with the default setting. Using MEGA5 [29], phylogenetic trees were constructed by the Neighbor Joining method on p-distances based on SNP sites. Bootstrapping was based on 200 replicates.

Multiple sequence alignments of full-length phage genomes, left and right arm coding regions, head protein sequences, and amidase sequences were each generated with MAFFT [30] or Muscle [31]. Phylogenetic trees were constructed in Seaview [32] based on the BioNJ method applied to the Jukes-Cantor distances between the sequences. All trees were bootstrapped for 5,000 replicates.

Determination of Variation Sites

Multiple sequence alignments of Group I and Group II phages were generated using MAFFT [30]. In each of these alignments, the positions of all mismatches and gaps (discrepancies) were recorded relative to a reference genome that was chosen at random. Contiguous gaps in the reference genome were counted as a single discrepancy. The reference genome was divided into 50-nucleotide windows, and the discrepancy density of each sequence window was calculated as the total number of discrepancies it contained. Densities were plotted in Artemis [33].

To determine the single-nucleotide variations within each strain, all read data for each phage, including reads not initially included in the de novo genome assembly, were mapped to their corresponding genomes using Mira. as the sites in each phage genome assembly.

Bacterial Resistance Test

The susceptibilities/resistances of *Propionibacterium* strains against 15 phages were determined using a modified cross-streak assay. The bacterial strains were cultured and streaked in parallel across A media plates (5-6 isolates on each plate, ~1 cm apart, along with ATCC 6919 as a control). Approximately 5 µL of 106 pfu/mL phage suspension was applied onto each streak, and then the plates were incubated at 37° C. anaerobically for 2 days. At least five replicates of each cross-streak experiment were performed to determine whether the strains were susceptible or resistant judged based on lysis. The resistance of the bacterial strains was further quantified by assaying the efficiency of plaquing of the phages relative to *P. acnes* strain ATCC 6919, calculated as the following:

$$\text{Resistance} = \frac{1}{\text{Efficiency of Plaquing}} = \frac{\text{Titer of Phase Strain } X \text{ on ATCC 6919}}{\text{Titer of Phase Strain } X \text{ on Bacterial Strain } Y}$$

A 100-fold or greater increase in efficiency of plaquing was considered to be evidence of resistance.

Phage Interaction Correlation

To determine whether genetically similar phages have similar host range and specificity, the correlation between their phylogenetic and phenotypic relationships was calculated, the latter based on results from the bacterial resistance test. Each column in the bacterial resistance table, which represents the host range of a given phage, was converted to binary form by assigning 1 to instances of resistance and 0 to instances of susceptibility. The Euclidean distance between each column was used to calculate a phenotype distance matrix between all phages. A phylogenetic distance matrix among the phage genomes was calculated using MEGA5 [29]. Using the ade4 package [34] in R, a Mantel test was performed on the phenotype and phylogenetic distance matrices to determine the correlation between the two. 10,000 permutations were performed.

CRISPR Search

CRISPR spacer sequences were identified in *P. acnes* genomes using CRISPRfinder [35]. The extracted spacer sequences were aligned against all phage sequences using BLASTn. Protospacers with up to two mismatches were identified.

Results

The genomes of 15 *P. acnes* phages isolated from human skin were sequenced. The phage genomes showed moderately high sequence similarity and were comparable in size and organization. Based on a comparison of the genomes, most phages diverge from each other, while some of them form closely-related groups that were not described previously. When tested against a panel of 69 *Propionibacterium* strains, these phages lysed all *P. acnes* strains except some strains from type IB-3 and II. Some of the phages were also able to lyse *Propionibacterium humerusii* strains. It was found that bacterial susceptibility/resistance to phages had no significant correlation with phage phylogeny or the presence of the CRISPR spacers in type II *P. acnes* strains that match the protospacers in the phage genomes.

Conclusions

With 15 new phageI genomes, it was determined that the diversity of *P. acnes* phages is broader than previously described with novel groups added. The host range and specificity are different among the phages, but are not correlated with the phylogeny of phage genomes. It was also found that encoding CRISPR spacers that match to phage genomes is not sufficient to confer *P. acnes* resistance to phages. This study provides new insight into the potential application of phages in treating acne and other *P. acnes* associated diseases.

REFERENCES CITED IN EXAMPLE 8

1. Mc Grath S, van Sinderen D (eds): Bacteriophage: Genetics and Molecular Biology. Norfolk, UK: Caister Academic Press; 2007.
2. Rohwer F: Global phage diversity. Cell 2003, 113:141.
3. Rohwer F, Thurber R V: Viruses manipulate the marine environment. Nature 2009, 459:207-212.
4. Suttle C A, Chan A M, Cottrell M T: Infection of Phytoplankton by Viruses and Reduction of Primary Productivity. Nature 1990, 347:467-469.
5. Rodriguez-Valera F, Martin-Cuadrado A B, Rodriguez-Brito B, Pasic L, Thingstad T F, Rohwer F, Mira A: Explaining microbial population genomics through phage predation. Nature reviews Microbiology 2009, 7:828-836.
6. Grice E A, Segre J A: The skin microbiome. Nature reviews Microbiology 2011, 9:244-253.
7. precedings.nature.com/documents/5305/version/1
8. Bojar R A, Holland K T: Acne and *Propionibacterium acnes*. Clin Dermatol 2004, 22:375-379.
9. Leyden J J: The evolving role of *Propionibacterium acnes* in acne. Semin Cutan Med Surg 2001, 20:139-143.
10. Zierdt C H, Webster C, Rude W S: Study of the anaerobic corynebacteria. International Journal of Systematic Bacteriology 1968, 18:33-47.
11. Lood R, Collin M: Characterization and genome sequencing of two *Propionibacterium acnes* phages displaying pseudolysogeny. BMC genomics 2011, 12:198.
12. Lood R, Morgelin M, Holmberg A, Rasmussen M, Collin M: Inducible Siphoviruses in superficial and deep tissue isolates of *Propionibacterium acnes*. BMC microbiology 2008, 8:139.
13. Jong E C, Ko H L, Pulverer G: Studies on bacteriophages of *Propionibacterium acnes*. Med Microbiol Immunol 1975, 161:263-271.
14. Webster G F, Cummins C S: Use of bacteriophage typing to distinguish *Propionibacterium* acne types I and II. Journal of clinical microbiology 1978, 7:84-90.
15. Farrar M D, Howson K M, Bojar R A, West D, Towler J C, Parry J, Pelton K, Holland K T: Genome sequence and analysis of a *Propionibacterium acnes* bacteriophage. Journal of bacteriology 2007, 189:4161-4167.
16. Horvath P, Barrangou R: CRISPR/Cas, the immune system of bacteria and archaea. Science 2010, 327:167-170.
17. Brzuszkiewicz E, Weiner J, Wollherr A, Thurmer A, Hupeden J, Lomholt H B, Kilian M, Gottschalk G, Daniel R, Mollenkopf H J, et al: Comparative genomics and transcriptomics of *Propionibacterium acnes*. PloS one 2011, 6:e21581.
18. Butler-Wu S M, Sengupta D J, Kittichotirat W, Matsen F A, 3rd, Bumgarner R E: Genome sequence of a novel species, *Propionibacterium humerusii*. Journal of bacteriology 2011, 193:3678.
19. Mojica F J, Diez-Villasenor C, Garcia-Martinez J, Almendros C: Short motif sequences determine the targets of the prokaryotic CRISPR defence system. Microbiology 2009, 155:733-740.
20. Westra E R, van Erp P B, Kunne T, Wong S P, Staals R H, Seegers C L, Bollen S, Jore M M, Semenova E, Severinov K, et al: CRISPR immunity relies on the consecutive binding and degradation of negatively supercoiled invader DNA by Cascade and Cas3. Molecular cell 2012, 46:595-605.
21. Semenova E, Jore M M, Datsenko K A, Semenova A, Westra E R, Wanner B, van der Oost J, Brouns S J, Severinov K: Interference by clustered regularly interspaced short palindromic repeat (CRISPR) RNA is governed by a seed sequence. Proceedings of the National Academy of Sciences of the United States of America 2011, 108:10098-10103.
22. Semenova E, Nagornykh M, Pyatnitskiy M, Artamonova, I I, Severinov K: Analysis of CRISPR system function in plant pathogen *Xanthomonas oryzae*. FEMS microbiology letters 2009, 296:110-116.
23. Srinivasiah S, Bhaysar J, Thapar K, Liles M, Schoenfeld T, Wommack K E: Phages across the biosphere: contrasts of viruses in soil and aquatic environments. Research in microbiology 2008, 159:349-357.
24. Chevreux B, Pfisterer T, Drescher B, Driesel A J, Muller W E, Wetter T, Suhai S: Using the miraEST assembler for reliable and automated mRNA transcript assembly and SNP detection in sequenced ESTs. Genome research 2004, 14:1147-1159.
25. Gordon D, Abajian C, Green P: Consed: a graphical tool for sequence finishing. Genome research 1998, 8:195-202.
26. Lukashin A V, Borodovsky M: GeneMark.hmm: new solutions for gene finding. Nucleic acids research 1998, 26:1107-1115.
27. Delcher A L, Harmon D, Kasif S, White O, Salzberg S L: Improved microbial gene identification with GLIMMER. Nucleic acids research 1999, 27:4636-4641.
28. Kurtz S, Phillippy A, Delcher A L, Smoot M, Shumway M, Antonescu C, Salzberg S L: Versatile and open software for comparing large genomes. Genome biology 2004, 5:R12.
29. Tamura K, Peterson D, Peterson N, Stecher G, Nei M, Kumar S: MEGA5: molecular evolutionary genetics analysis using maximum likelihood, evolutionary distance, and maximum parsimony methods. Molecular biology and evolution 2011, 28:2731-2739.
30. Katoh K, Misawa K, Kuma K, Miyata T: MAFFT: a novel method for rapid multiple sequence alignment based on fast Fourier transform. Nucleic acids research 2002, 30:3059-3066.
31. Edgar R C: MUSCLE: multiple sequence alignment with high accuracy and high throughput. Nucleic acids research 2004, 32:1792-1797.
32. Gouy M, Guindon S, Gascuel O: SeaView version 4: A multiplatform graphical user interface for sequence alignment and phylogenetic tree building. Molecular biology and evolution 2010, 27:221-224.
33. Rutherford K, Parkhill J, Crook J, Horsnell T, Rice P, Rajandream M A, Barrell B: Artemis: sequence visualization and annotation. Bioinformatics 2000, 16:944-945.
34. Dray S, Dufour A B: The ade4 package: Implementing the duality diagram for ecologists. Journal of Statistical Software 2007, 22:1-20.
35. Grissa I, Vergnaud G, Pourcel C: CRISPRFinder: a web tool to identify clustered regularly interspaced short palindromic repeats. Nucleic acids research 2007, 35:W52-57.

(Nature Precedings Paper). (n.d.). Retrieved from precedings.nature.com/documents/5305/version/1

Bojar, R. a, & Holland, K. T. (2004). Acne and *Propionibacterium acnes*. Clinics in dermatology, 22(5), 375-9. doi:10.1016/j.clindermatol.2004.03.005

Farrar, M. D., Howson, K. M., Bojar, R. a, West, D., Towler, J. C., Parry, J., Pelton, K., et al. (2007). Genome sequence and analysis of a *Propionibacterium acnes* bacteriophage. Journal of bacteriology, 189(11), 4161-7. doi:10.1128/JB.00106-07

Grice, E. a, & Segre, J. a. (2011). The skin microbiome. Nature reviews. Microbiology, 9(4), 244-53. doi:10.1038/nrmicro2537

Leyden, J. J. (2001). The evolving role of *Propionibacterium acnes* in acne. Seminars in cutaneous medicine and surgery, 20(3), 139-43. doi:10.1053/sder.2001.28207

Lood, R., & Collin, M. (2011). Characterization and genome sequencing of two *Propionibacterium acnes* phages displaying pseudolysogeny. BMC genomics, 12(1), 198. doi:10.1186/1471-2164-12-198

Marinelli, L. J., Fitz-gibbon, S., Hayes, C., Bowman, C., Inkeles, M., Loncaric, A., & Russell, D. A. (2012). *Propionibacterium acnes* Bacteriophages Display Limited Genetic Diversity and Broad Killing Activity against Bacterial Skin Isolates. mBio, 3(5), 1-13. doi:10.1128/mBio.00279-12.Editor Mc Grath, S., & van Sinderen, D. (eds). (2007). Bacteriophage: Genetics and Molecular Biology. Norfolk, UK: Caister Academic Press.

Roche Diagnostics. (2009). G S FLX Titanium General Library Preparation Method Manual. Mannheim: Roche Diagnostics GmbH.

Rodriguez-Valera, F., Martin-Cuadrado, A.-B., Rodriguez-Brito, B., Pasić, L., Thingstad, T. F., Rohwer, F., & Mira, A. (2009). Explaining microbial population genomics through phage predation. Nature reviews. Microbiology, 7(11), 828-36. doi:10.1038/nrmicro2235

Rohwer, F. (2003). Global phage diversity. Cell, 113(2), 141.

Zierdt, C. H., Webster, C., & Rude, W. S. (1968). Study of the anaerobic corynebacteria. International Journal of Systematic Bacteriology, 18, 33-47.

All the strains of RT4, RT5, and RT8 show sensitivity to all of the phages shown in Table 5. Therefore, acne patients may be treated with phage by using phage strains that are listed in Table 5:

TABLE 5

Host range and specificity of *P. acnes* phages

| | RecA Type | Ribotype | CRIS P./Cas | PHL113M01 | PHL111M01 | PHL082M00 | PHL060L00 |
|---|---|---|---|---|---|---|---|
| HL036PA1 | IA | 532 | – | S | S | S | S |
| HL036PA2 | | 532 | – | S | S | S | S |
| HL036PA3 | | 1 | – | S | S | S | S |
| HL046PA2 | | 1 | – | S | S | S | S |
| HL002PA3 | | 1 | – | S | S | S | S |
| HL002PA2 | | 1 | – | S | S | S | S |
| HL005PA2 | | 1 | – | S | S | S | S |
| HL005PA3 | | 1 | – | S | S | S | S |
| HL020PA1 | | 1 | – | S | S | S | S |
| HL027PA2 | | 1 | – | S | S | S | S |
| HL100PA1 | | 1 | – | S | S | S | S |
| HL087PA2 | | 1 | – | S | S | S | S |
| HL013PA2 | | 1 | – | S | S | S | S |
| HL063PA1 | | 1 | – | S | S | S | S |
| HL072PA1 | | 5 | – | S | S | S | S |
| HL072PA2 | | 5 | – | S | S | S | S |
| HL106PA2 | | 1 | – | S | S | S | S |
| HL099PA1 | | 4 | – | S | S | S | S |
| HL083PA1 | | 1 | – | S | S | S | S |
| HL038PA1 | | 4 | – | S | S | S | S |
| HL074PA1 | | 4 | – | S | S | S | S |
| HL005PA1 | | 4 | – | S | S | S | S |
| HL056PA1 | | 4 | – | S | S | S | S |
| HL053PA1 | | 4 | – | S | S | S | S |
| HL045PA1 | | 4 | – | S | S | S | S |
| HL007PA1 | | 4 | – | S | S | S | S |
| HL096PA1 | | 5 | – | S | S | S | S |
| HL043PA1 | | 5 | – | S | S | S | S |
| HL043PA2 | | 5 | – | S | S | S | S |
| HL078PA1 | | 1 | – | S | S | S | S |
| HL086PA1 | IB | 8 | – | S | S | S | S |
| HL082PA1 | | 8 | – | S | S | S | S |
| HL110PA2 | | 8 | – | S | S | S | S |
| HL053PA3 | | 8 | – | S | S | S | S |
| HL092PA1 | | 8 | – | S | S | S | S |
| HL110PA1 | | 8 | – | S | S | S | S |
| HL025PA1 | | 1 | – | S | S | S | S |
| HL030PA2 | | 3 | – | S | S | S | S |
| HL063PA2 | | 3 | – | S | S | S | S |
| HL037PA1 | | 3 | – | S | S | S | S |
| HL059PA1 | | 16 | – | S | S | S | S |
| HL059PA2 | | 16 | – | S | S | S | S |
| HL025PA2 | | 3 | – | S | S | S | S |
| HL005PA4 | | 3 | – | S | S | S | S |
| HL067PA1 | | 3 | – | S | S | S | S |
| HL002PA1 | | 3 | – | S | S | S | S |
| HL027PA1 | | 3 | – | S | S | S | S |
| HL046PA1 | | 3 | – | S | S | S | S |
| HL083PA2 | | 3 | – | S | S | S | S |

TABLE 5-continued

Host range and specificity of *P. acnes* phages

| | | | | | | | |
|---|---|---|---|---|---|---|---|
| HL013PA1 | | 3 | – | S | S | S | S |
| HL050PA1 | | 3 | – | S | S | S | S |
| HL050PA3 | | 3 | – | S | S | S | S |
| HL087PA1 | | 3 | – | S | S | S | S |
| HL087PA3 | | 3 | – | S | S | S | S |
| KPA171202 | | 1 | – | S | >$10^4$ | S | >$10^4$ |
| HL030PA1 | | 1 | – | >$10^4$ | S | S | S |
| HL050PA2 | II | 1 | – | S | S | S | S |
| HL060PA1 | | 2 | + | S | S | S | S |
| HL082PA2 | | 2 | + | S | S | S | S |
| HL001PA1 | | 2 | + | S | >$10^7$ | S | S |
| HL106PA1 | | 2 | + | S | S | S | S |
| ATCC11828 | | 2 | + | S | S | S | S |
| HL110PA3 | | 6 | + | S | S | S | S |
| HL110PA4 | | 6 | + | S | S | S | S |
| HL042PA3 | | 6 | + | S | >$10^7$ | >$10^7$ | S |
| HL037PA2 | — | *P. humerusii* | – | S | S | S | S |
| HL037PA3 | | *P. humerusii* | – | S | S | S | S |
| HL044PA1 | | *P. humerusii* | – | S | S | S | >$10^7$ |
| HL078PG1 | — | *P. granulosum* | | >$10^7$ | >$10^7$ | >$10^7$ | >$10^7$ |

| | RerA Type | PHL067M10 | PHL071N05 | PHL112N00 | PHL037202 | PHL085N00 | PHL115M02 |
|---|---|---|---|---|---|---|---|
| HL036PA1 | IA | S | S | S | S | S | S |
| HL036PA2 | | S | S | S | S | S | S |
| HL036PA3 | | S | S | S | S | S | S |
| HL046PA2 | | S | S | S | S | S | S |
| HL002PA3 | | S | S | S | S | S | S |
| HL002PA2 | | S | S | S | S | S | S |
| HL005PA2 | | S | S | S | S | S | S |
| HL005PA3 | | S | S | S | S | S | S |
| HL020PA1 | | S | S | S | S | S | S |
| HL027PA2 | | S | S | S | S | S | S |
| HL100PA1 | | S | S | S | S | S | S |
| HL087PA2 | | S | S | S | S | S | S |
| HL013PA2 | | S | S | S | S | S | S |
| HL063PA1 | | S | S | S | S | S | S |
| HL072PA1 | | S | S | S | S | S | S |
| HL072PA2 | | S | S | S | S | S | S |
| HL106PA2 | | S | S | S | S | S | S |
| HL099PA1 | | S | S | S | S | S | S |
| HL083PA1 | | S | S | S | S | S | S |
| HL038PA1 | | S | S | S | S | S | S |
| HL074PA1 | | S | S | S | S | S | S |
| HL005PA1 | | S | S | S | S | S | S |
| HL056PA1 | | S | S | S | S | S | S |
| HL053PA1 | | S | S | S | S | S | S |
| HL045PA1 | | S | S | S | S | S | S |
| HL007PA1 | | S | S | S | S | S | S |
| HL096PA1 | | S | S | S | S | S | S |
| HL043PA1 | | S | S | S | S | S | S |
| HL043PA2 | | S | S | S | S | S | S |
| HL078PA1 | | S | S | S | S | S | S |
| HL086PA1 | IB | S | S | S | S | S | S |
| HL082PA1 | | S | S | S | S | S | S |
| HL110PA2 | | S | S | S | S | S | S |
| HL053PA3 | | S | S | S | S | S | S |
| HL092PA1 | | S | S | S | S | S | S |
| HL110PA1 | | S | S | S | S | S | S |
| HL025PA1 | | S | S | S | S | S | S |
| HL030PA2 | | S | S | S | S | S | S |
| HL063PA2 | | S | S | S | S | S | S |
| HL037PA1 | | S | S | S | S | S | S |
| HL059PA1 | | S | S | S | S | S | S |
| HL059PA2 | | S | S | S | S | S | S |
| HL025PA2 | | S | S | S | S | S | S |
| HL005PA4 | | S | S | S | S | S | S |
| HL067PA1 | | S | S | S | S | S | S |
| HL002PA1 | | S | S | S | S | S | S |
| HL027PA1 | | S | S | S | S | S | S |
| HL046PA1 | | S | S | S | S | S | S |
| HL083PA2 | | S | S | S | S | S | S |
| HL013PA1 | | S | S | S | S | S | S |
| HL050PA1 | | S | S | S | S | S | S |
| HL050PA3 | | S | S | S | S | S | S |
| HL087PA1 | | S | S | S | S | S | S |
| HL087PA3 | | S | S | S | S | S | S |

TABLE 5-continued

Host range and specificity of *P. acnes* phages

| | | | | | | | |
|---|---|---|---|---|---|---|---|
| KPA171202 | | >$10^5$ | S | >$10^7$ | >$10^7$ | >$10^7$ | >$10^7$ |
| HL030PA1 | | >$10^2$ | S | >$10^3$ | >$10^7$ | >$10^7$ | >$10^7$ |
| HL050PA2 | II | >$10^4$ | S | S | S | S | S |
| HL060PA1 | | S | S | S | S | S | S |
| HL082PA2 | | S | S | S | S | S | S |
| HL001PA1 | | >$10^7$ | S | S | S | S | S |
| HL106PA1 | | S | S | S | S | S | S |
| ATCC11828 | | S | S | S | S | S | S |
| HL110PA3 | | S | S | S | S | S | S |
| HL110PA4 | | S | S | S | S | S | S |
| HL042PA3 | | >$10^7$ | >$10^5$ | S | >$10^7$ | >$10^7$ | >$10^7$ |
| HL037PA2 | — | S | S | S | S | S | S |
| HL037PA3 | | S | S | S | S | S | S |
| HL044PA1 | | S | S | >$10^4$ | >$10^7$ | S | >$10^2$ |
| HL078PG1 | — | >$10^7$ | >$10^7$ | >$10^7$ | >$10^7$ | >$10^7$ | >$10^7$ |

| | | RerA Type | PHL085M01 | PHL114L00 | PHL073M02 | PHL010M04 | PHL066M04 |
|---|---|---|---|---|---|---|---|
| | HL036PA1 | IA | S | S | S | S | S |
| | HL036PA2 | | S | S | S | S | S |
| | HL036PA3 | | S | S | S | S | S |
| | HL046PA2 | | S | S | S | S | S |
| | HL002PA3 | | S | S | S | S | S |
| | HL002PA2 | | S | S | S | S | S |
| | HL005PA2 | | S | S | S | S | S |
| | HL005PA3 | | S | S | S | S | S |
| | HL020PA1 | | S | S | S | S | S |
| | HL027PA2 | | S | S | S | S | S |
| | HL100PA1 | | S | S | S | S | S |
| | HL087PA2 | | S | S | S | S | S |
| | HL013PA2 | | S | S | S | S | S |
| | HL063PA1 | | S | S | S | S | S |
| | HL072PA1 | | S | S | S | S | S |
| | HL072PA2 | | S | S | S | S | S |
| | HL106PA2 | | S | S | S | S | S |
| | HL099PA1 | | S | S | S | S | S |
| | HL083PA1 | | S | S | S | S | S |
| | HL038PA1 | | S | S | S | S | S |
| | HL074PA1 | | S | S | S | S | S |
| | HL005PA1 | | S | S | S | S | S |
| | HL056PA1 | | S | S | S | S | S |
| | HL053PA1 | | S | S | S | S | S |
| | HL045PA1 | | S | S | S | S | S |
| | HL007PA1 | | S | S | S | S | S |
| | HL096PA1 | | S | S | S | S | S |
| | HL043PA1 | | S | S | S | S | S |
| | HL043PA2 | | S | S | S | S | S |
| | HL078PA1 | | S | S | S | S | S |
| | HL086PA1 | IB | S | S | S | S | S |
| | HL082PA1 | | S | S | S | S | S |
| | HL110PA2 | | S | S | S | S | S |
| | HL053PA3 | | S | S | S | S | S |
| | HL092PA1 | | S | S | S | S | S |
| | HL110PA1 | | S | S | S | S | S |
| | HL025PA1 | | S | S | S | S | S |
| | HL030PA2 | | S | S | S | S | S |
| | HL063PA2 | | S | S | S | S | S |
| | HL037PA1 | | S | S | S | S | S |
| | HL059PA1 | | S | S | S | S | S |
| | HL059PA2 | | S | S | S | S | S |
| | HL025PA2 | | S | S | S | S | S |
| | HL005PA4 | | S | S | S | S | S |
| | HL067PA1 | | S | S | S | S | S |
| | HL002PA1 | | S | S | S | S | S |
| | HL027PA1 | | S | S | S | S | S |
| | HL046PA1 | | S | S | S | S | S |
| | HL083PA2 | | S | S | S | S | S |
| | HL013PA1 | | S | S | S | S | S |
| | HL050PA1 | | S | S | S | S | S |
| | HL050PA3 | | S | S | S | S | S |
| | HL087PA1 | | S | S | S | S | S |
| | HL087PA3 | | S | S | S | S | S |
| | KPA171202 | | >$10^4$ | >$10^4$ | >$10^4$ | >$10^5$ | >$10^7$ |
| | HL030PA1 | | >$10^4$ | >$10^4$ | >$10^4$ | >$10^5$ | >$10^4$ |
| | HL050PA2 | II | S | S | S | S | S |
| | HL060PA1 | | S | S | S | S | S |
| | HL082PA2 | | S | S | S | S | S |

TABLE 5-continued

Host range and specificity of *P. acnes* phages

| | | | | | |
|---|---|---|---|---|---|
| HL001PA1 | S | >10⁷ | S | S | S |
| HL106PA1 | S | S | S | S | S |
| ATCC11828 | S | S | S | S | S |
| HL110PA3 | S | S | S | S | S |
| HL110PA4 | S | S | S | S | S |
| HL042PA3 | S | >10⁷ | >10⁷ | >10⁷ | >10⁷ |
| HL037PA2 | — | S | S | S | S |
| HL037PA3 | S | S | S | S | S |
| HL044PA1 | S | S | S | S | >10⁷ |
| HL078PG1 | — | >10⁷ | >10⁷ | >10⁷ | >10⁷ |

S susceptible
10⁺ fold increase in resistance

Strains in the IB-3 lineage show resistance against most of the tested phages. Therefore, patients with those strains may not benefit as much from phage therapy. SEQ ID NOs 55-81 include four unique genomic sequences for strains in the IB-3 lineage and for several other strains, such as IB-3-s1 (IB-3 and SK187), IB-3-s2 (IB-3 and HL025PA1), IB-3-s3 (IB-3 and HL201PA1), IB-3-s4 (IB-3 and HL201PA1). The sequence similarities range from 95% to 100%. Primers targeting these sequences can be used to estimate and predict the effectiveness of phage therapy.

Figure 26:
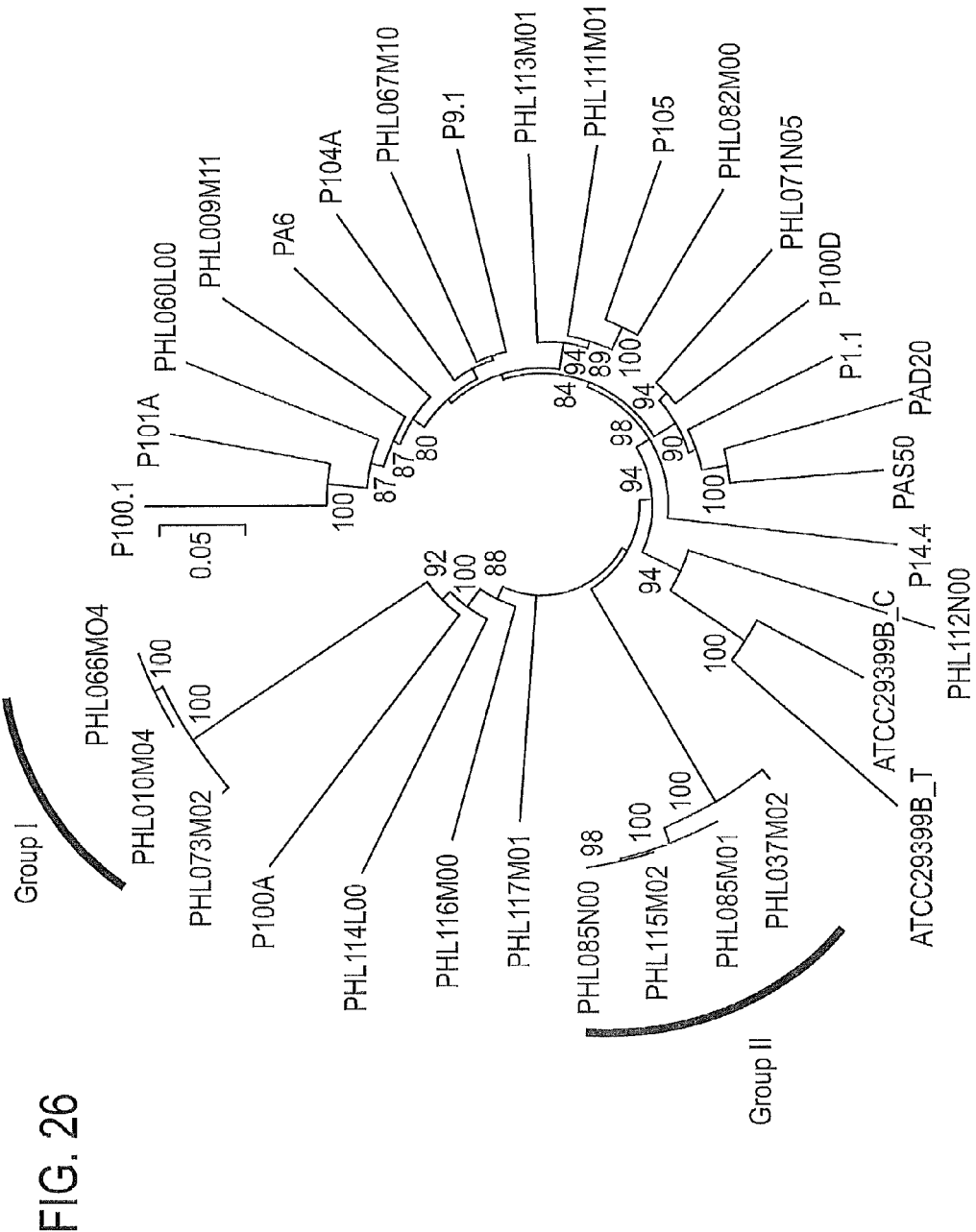
FIG. 26 shows the evolutionary relationships/phylogenetic tree of 32 phages.
Figure 27:
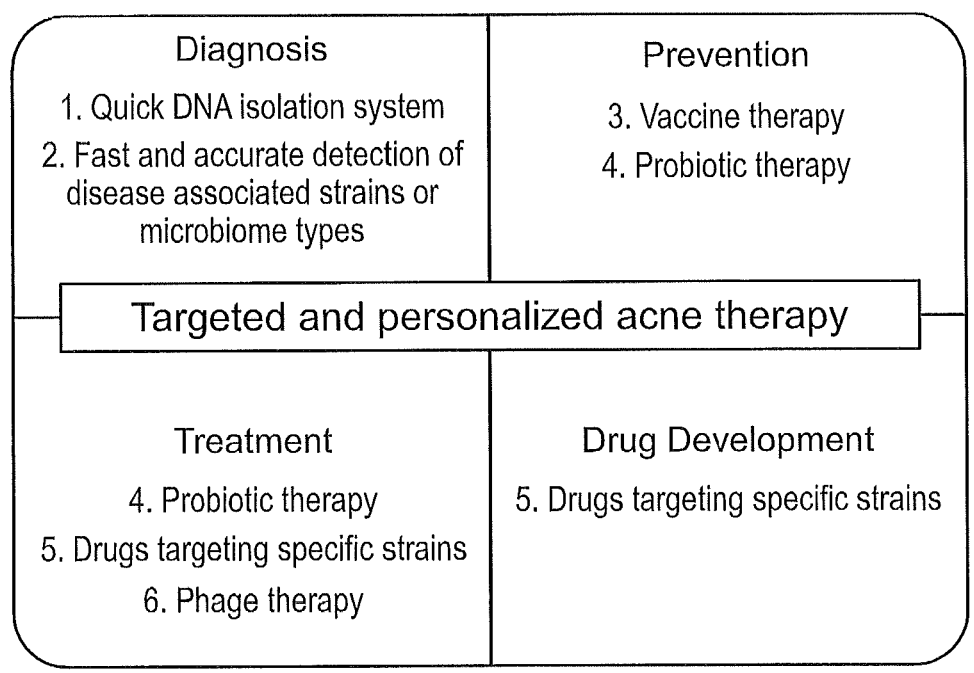
FIG. 27 shows a diagram of the methods of the invention for the diagnosis and personalization of therapy for acne.
Figure 28:
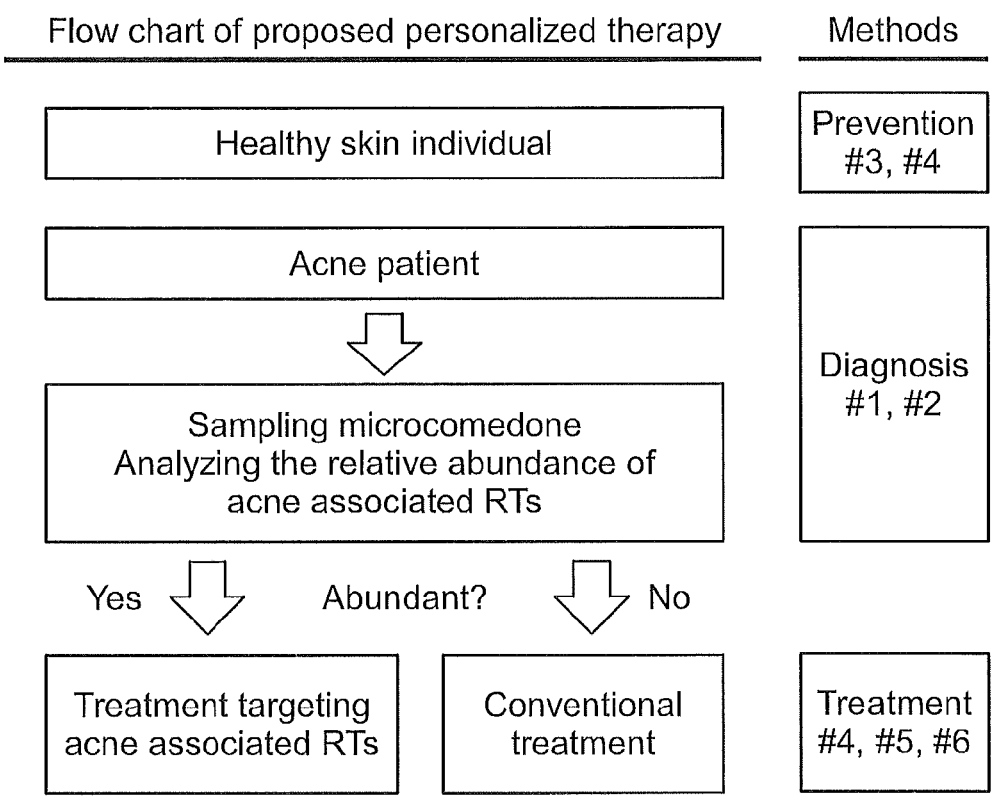
FIG. 28 shows a flow chart of the methods of the invention for the diagnosis and personalization of therapy for acne.

FIG. 26 shows the phylogenetic tree of the 32 phages including the 18 sequenced phages. There are phage strains highly similar to each other, such as the ones in Groups I and II. This suggests that the same phages can be found in different individuals and supports that a particular phage strain can be used as a common treatment agent for different individuals. SEQ ID NOs 33-50 reflect the genome sequences of the 18 sequenced phages, including the 15 phages shown in Table 5.

Potential Therapeutic Phage for Patients with Microbiome Type I Include:
  PHL113M01, PHL111M01, PHL082M00, PHL060L00, PHL067M10, PHL071N05, PHL112N00, PHL037M02, PHL085N00, PHL115M02, PHL085M01, PHL114L00, PHL073M02, PHL010M04, and PHL066M04.

Potential Therapeutic Phage for Patients with Microbiome Type I with IB-3 Strain Include:
  PHL082M00 and PHL071N05.

Potential Therapeutic Phage for Patients with Microbiome Type II Include:
  PHL113M01, PHL060L00, PHL112N00, and PHL085M01.

Potential Therapeutic Phage for Patients with Microbiome Type III or Dominant RT8 Include:
  PHL113M01, PHL111M01, PHL082M00, PHL060L00, PHL067M10, PHL071N05, PHL112N00, PHL037M02, PHL085N00, PHL115M02, PHL085M01, PHL114L00, PHL073M02, PHL010M04, and PHL066M04.

Potential Therapeutic Phage for Patients with Microbiome Type IV Include:
  PHL113M01, PHL111M01, PHL082M00, PHL060L00, PHL067M10, PHL071N05, PHL112N00, PHL037M02, PHL085N00, PHL115M02, PHL085M01, PHL114L00, PHL073M02, PHL010M04, and PHL066M04.

Potential Therapeutic Phage for Patients with Microbiome Type V Include:
  PHL113M01, PHL111M01, PHL082M00, PHL060L00, PHL067M10, PHL071N05, PHL112N00, PHL037M02, PHL085N00, PHL115M02, PHL085M01, PHL114L00, PHL073M02, PHL010M04, and PHL066M04.

Specific Interactions Between *Propionibacterium humerusii* and *P. acnes* Phages Some of the *P. acnes* phage strains can lyse a closely related *Propionibacterium* species, *P. humerusii*, which has been hypothesized to be associated with infection in prostheses. *P. acnes* phage strains that can lyse *P. humerusii* strains can be potentially used as a therapeutic agent for *P. humerusii* associated diseases.

Potential Therapeutic Phage for *P. humerusii* Associated Diseases Include:
  PHL113M01, PHL111M01, PHL082M00, PHL067M10, PHL071N05, PHL085N00, PHL085M01, PHL114L00, PHL073M02, and PHL010M04.

ORFs in Phage Genomes that Show Identity of 85% or Less to their PA6 Homolog

| phage_gene name | nucleotide differences | percent difference relative to PA6 | PA6 ORF length |
|---|---|---|---|
| PA6_gp10 | | | 372 |
| PHL111M01_gp9 | 56 | 0.849462366 | |
| PHL112N00_gp9 | 60 | 0.838709677 | |
| PHL114L00_gp10 | 60 | 0.838709677 | |
| PHL010M04_gp11 | 56 | 0.849462366 | |
| PHL082M00_gp10 | 60 | 0.838709677 | |
| PA6_gp19 | | | 747 |
| PHL114L00_gp19 | 120 | 0.83935743 | |
| PHL010M04_gp20 | 138 | 0.815261044 | |
| PHL066M04_gp20 | 138 | 0.815261044 | |
| PHL073M02_gp20 | 138 | 0.815261044 | |
| PA6_gp44 | | | 309 |
| PHL060L00_gp47 | 83 | 0.731391586 | |
| PHL010M04_gp43 | 75 | 0.757281553 | |
| PHL066M04_gp43 | 74 | 0.760517799 | |
| PHL073M02_gp43 | 74 | 0.760517799 | |
| PHL067M10_gp43 | 74 | 0.760517799 | |
| PHL082M00_gp43 | 66 | 0.786407767 | |
| PA6_gp33 | | | 357 |
| PHL115M02_gp37 | 54 | 0.848739496 | |
| PHL085M01_gp32 | 54 | 0.848739496 | |
| PHL037M02_gp31 | 54 | 0.848739496 | |
| PHL085N00_gp32 | 54 | 0.848739496 | |
| PA6_gp45 | | | 183 |
| PHL111M01_gp44 | 33 | 0.819672131 | |
| PA6_gp21 | | | 402 |
| PHL112N00_gp20 | 71 | 0.823383085 | |
| PHL010M04_gp22 | 85 | 0.788557214 | |
| PHL066M04_gp22 | 84 | 0.791044776 | |
| PHL073M02_gp22 | 78 | 0.805970149 | |
| PHL071N05_gp21 | 61 | 0.848258706 | |
| PHL067M10_gp22 | 63 | 0.843283582 | |
| PHL115M02_gp26 | 65 | 0.838308458 | |
| PHL085M01_gp22 | 65 | 0.838308458 | |
| PHL037M02_gp21 | 65 | 0.838308458 | |
| PHL085N00_gp22 | 65 | 0.838308458 | |
| PA6_gp40 | | | 228 |
| PHL111M01_gp41 | 37 | 0.837719298 | |
| PHL060L00_gp42 | 37 | 0.837719298 | |

-continued

| phage_gene name | nucleotide differences | percent difference relative to PA6 | PA6 ORF length |
|---|---|---|---|
| PHL112N00_gp39 | 54 | 0.763157895 | |
| PHL113M01_gp43 | 38 | 0.833333333 | |
| PHL114L00_gp40 | 40 | 0.824561404 | |
| PHL010M04_gp40 | 50 | 0.780701754 | |
| PHL066M04_gp40 | 50 | 0.780701754 | |
| PHL073M02_gp40 | 50 | 0.780701754 | |
| PHL071N05_gp39 | 39 | 0.828947368 | |
| PHL067M10_gp40 | 37 | 0.837719298 | |
| PHL115M02_gp45 | 43 | 0.811403509 | |
| PHL085M01_gp40 | 43 | 0.811403509 | |
| PHL037M02_gp39 | 43 | 0.811403509 | |
| PHL085N00_gp40 | 43 | 0.811403509 | |
| PHL082M00_gp39 | 42 | 0.815789474 | |
| PA6_gp22_23 | | | 504 |
| PHL114L00_gp22 | 187 | 0.628968254 | |
| PHL010M04_gp23 | 110 | 0.781746032 | |
| PHL066M04_gp23 | 110 | 0.781746032 | |
| PHL073M02_gp23 | 110 | 0.781746032 | |
| PHL067M10_gp23 | 186 | 0.630952381 | |
| PA6_gp29 | | | 567 |
| PHL060L00_gp30 | 88 | 0.844797178 | |
| PHL112N00_gp27 | 105 | 0.814814815 | |
| PHL114L00_gp28 | 98 | 0.827160494 | |
| PA6_gp35 | | | 471 |
| PHL114L00_gp33 | 76 | 0.838641189 | |
| PA6_gp41 | | | 540 |
| PHL111M01_gp42 | 109 | 0.798148148 | |
| PHL060L00_gp43 | 104 | 0.807407407 | |
| PHL112N00_gp40 | 118 | 0.781481481 | |
| PHL113M01_gp44 | 107 | 0.801851852 | |
| PHL114L00_gp41 | 124 | 0.77037037 | |
| PHL071N05_gp40 | 110 | 0.796296296 | |
| PHL067M10_gp41 | 119 | 0.77962963 | |
| PHL115M02_gp46 | 112 | 0.792592593 | |
| PHL085M01_gp41 | 112 | 0.792592593 | |
| PHL037M02_gp40 | 112 | 0.792592593 | |
| PHL085N00_gp41 | 112 | 0.792592593 | |
| PHL082M00_gp40 | 111 | 0.794444444 | |
| PA6_gp47 | | | 180 |
| PHL115M02_gp50 | 35 | 0.805555556 | |
| PHL085M01_gp45 | 35 | 0.805555556 | |
| PHL037M02_gp44 | 35 | 0.805555556 | |
| PHL111M01_gp45 | 43 | 0.761111111 | |
| PHL071N05_gp44.1 | 32 | 0.822222222 | |
| PHL114L00_gp45.1 | 38 | 0.788888889 | |
| PHL113M01_gp47 | 31 | 0.827777778 | |
| PHL085N0_gp45 | 35 | 0.805555556 | |
| PA6_gp24 | | | 393 |
| PHL114L00_gp23 | 75 | 0.809160305 | |
| PHL010M04_gp24 | 66 | 0.832061069 | |
| PHL066M04_gp24 | 66 | 0.832061069 | |
| PHL073M02_gp24 | 66 | 0.832061069 | |
| PHL067M10_gp24 | 61 | 0.844783715 | |
| PHL15M02_gp29 | 65 | 0.834605598 | |
| PHL085M01_gp24 | 65 | 0.834605598 | |
| PHL037M02_gp23 | 65 | 0.834605598 | |
| PHL085N00_gp24 | 65 | 0.834605598 | |
| PA6_gp30 | | | 564 |
| PHL111M01_gp29 | 115 | 0.796099291 | |
| PHL113M01_gp31 | 105 | 0.813829787 | |
| PHL082M00_gp29 | 116 | 0.794326241 | |
| PA6_gp18 | | | 264 |
| PHL112N00_gp17 | 40 | 0.848484848 | |
| PHL082M00_gp18 | 41 | 0.84469697 | |
| PA6_gp37 | | | 948 |
| PHL112N00_gp34 | 168 | 0.82278481 | |
| PHL114L00_gp35 | 163 | 0.828059072 | |
| PA6_gp36 | | | 411 |
| PHL111M01_gp36 | 80 | 0.805352798 | |
| PHL112N00_gp33 | 76 | 0.815085158 | |
| PHL113M01_gp38 | 82 | 0.800486618 | |
| PHL114L00_gp34 | 86 | 0.790754258 | |
| PHL010M04_gp35 | 82 | 0.800486618 | |
| PHL066M04_gp35 | 82 | 0.800486618 | |
| PHL073M02_gp35 | 82 | 0.800486618 | |
| PHL071N05_gp34 | 82 | 0.800486618 | |
| PHL115M02_gp40 | 68 | 0.834549878 | |
| PHL085M01_gp35 | 68 | 0.834549878 | |
| PHL037M02_gp34 | 68 | 0.834549878 | |
| PHL085N00_gp35 | 68 | 0.834549878 | |
| PHL082M00_gp34 | 85 | 0.793187348 | |

Example 9—Drug Development

Based on the foregoing, it is now known that some *P. acnes* strains are associated with acne. Therefore, at the time of diagnosis, it will be useful for dermatologists to know which strains are dominant on the skin of the patient. In order to do this, at first one needs to extract bacterial DNA from the skin sample of the patient. The method/kit to isolate bacterial DNA from the skin for downstream analysis detailed above can be implemented in practice. After bacterial DNA is extracted, the fast and accurate detection/diagnosis method/kit to identify the microbiome type of the patients, detailed above, can be implemented for diagnosis. Once the microbiome type of the patient is diagnosed, several approaches can be used to treat the patient.

For example, if the patient has microbiome types IV or V, or is dominated by *P. acnes* RT10 strains, it is less likely antibiotic treament would succeed, because these strains are antibiotic resistant. These patients should be treated using other therapies, such as retinoids or the methods. In the case that the patient has the virulent ribotypes, including RT4, RT5, and RT8, drugs targeting specifically to RT4, RT5, and RT8, can be used. For example, small molecules, antisense molecules, siRNA, biologics, antibodies, or combinations thereof targeting the genetic elements and biological pathways unique to the *P. acnes* strains associated with acne, detailed above, can be used.

Example 10—Additional Therapies

In the case that the dominant *P. acnes* strains in the patient do not harbor a set of CRISPR/Cas, additional treatment of phage therapy based on the foregoing can be used. For example, bacteriophage-based strain-specific therapy to treat acne can be employed. An alternative treatment strategy is to balance the relative abundance of the *P. acnes* strains by promoting the growth of health-associated strains. The strains associated with health can be used as probiotics. These can be topical creams, solutions, or other cosmetic products.

For prevention purposes, vaccine can be developed against virulent strains of *P. acnes*.

Longitudinal studies determine whether the microbiome types change over time and whether certain strains persist on subjects after treatment.

Inoculation experiments, inoculating virulent and healthy strains, determine whether *P. acnes* strain population changes.

Specific interactions between *P. acnes* strains and phages may be studied.

Immune responses in human cells against different strains of *P. acnes* may also be measured.

The following publications are incorporated herein by reference in their entireties for all purposes, as are all other publications referenced herein and the Sequence Listing:

E. Grice et al., 324 Science 1190-1192 (2009).

SEQUENCE LISTING (504 sequences)

SEQ ID NO: 1 - DNA, 1504 bp, Propionibacterium acnes
acgaacgctggcggcgtgcttaacacatgcaagtcgaacggaaaggccctgcttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgtaaagggctcgtaggtggttgatcgcgtcggaagtgtaatcttggggcttaaccctgagcgtgctttcgatacgggttgacttgaggaaggtaggggagaatggaattcctggtggagcggtggaatgcgcagatatcaggaggaacaccagtggcgaaggcggttctctgggcctttcctgacgctgaggagcgaaagcgtggggagcgaacaggcttagataccctggtagtccacgctgtaaacggtgggtactaggtgtggggtccattccacgggttccgtgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagtgctcagagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtagccgtaccggaaggtgcggctggatcacctcctttctaagga

SEQ ID NO: 2 - DNA, 1504 bp, Propionibacterium acnes
acgaacgctggcggcgtgcttaacacatgcaagtcgaacggaaaggccctgcttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgtaaagggctcgtaggtggttgatcgcgtcggaagtgtaatcttggggcttaaccctgagcgtgctttcgatacgggttgacttgaggaaggtaggggagaatggaattcctggtggagcggtggaatgcgcagatatcaggaggaacaccagtggcgaaggcggttctctgggcctttcctgacgctgaggagcgaaagcgtggggagcgaacaggcttagataccctggtagtccacgctgtaaacggtgggtactaggtgtggggtccattccacgggttccgcgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagtgctcagagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtagccgtaccggaaggtgcggctggatcacctcctttctaagga

SEQ ID NO: 3 - DNA, 1504 bp, Propionibacterium acnes
acgaacgctggcggcgtgcttaacacatgcaagtcgaacggaaaggccctgcttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgtaaagggctcgtaggtggttgatcgcgtcggaagtgtaatcttggggcttaaccctgagcgtgctttcgatacgggttgacttgaggaaggtaggggagaatggaattcctggtggagcggtggaatgcgcagatatcaggaggaacaccagtggcgaaggcggttctctgggcctttcctgacgctgaggagcgaaagcgtggggagcgaacaggcttagataccctggtagtccacgctgtaaacggtgggtactaggtgtggggtccattccacgggttccgtgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagcgctcagagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtagccgtaccggaaggtgcggctggatcacctcctttctaagga

SEQ ID NO: 4 - DNA, 1504 bp, Propionibacterium acnes
acgaacgctggcggcgtgcttaacacatgcaagtcgaacggaaaggccctgcttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgtaaagggctcgtaggtggttgatcgcgtcggaagtgtaatcttggggcttaaccctgagcgtgctttcgatacgggttgacttgaggaaggtaggggagaatggaattcctggtggagcggtggaatgcgcagatatcaggaggaacaccagtggcgaaggcggttctctgggcctttcctgacgctgaggagcgaaagcgtggggagcgaacaggcttagataccctggtagtccacgctgtaaacggtgggtactaggtgtggggtccattccacgggttccgtgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagtgctcagagatgggtgtgcctcttttggggtcggttcacaggtggtgcatgcctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcctcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtagccgtaccggaaggtgcggctggatcacctcctttctaagga

SEQ ID NO: 5 - DNA, 1504 bp, Propionibacterium acnes
acgaacgctggcggcgtgcttaacacatgcaagtcgaacggaaaggccctgcttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgtaaagggctcgtaggtggttgatcgcgtcggaagtgtaatcttggggcttaaccctgagcgtgctttcgatacgggttgacttgaggaaggtaggggagaatggaattcctggtggagcggtggaatgcgcagatatcaggaggaacaccagtggcgaaggcggttctctgggcctttcctgacgctgaggagcgaaagcgtggggagcgaacaggcttagataccctggtagtccacgctgtaaacggtgggtactaggtgtggggtccattccacgggttccgtgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagtgctcagagatgggtgtgcctcttttggggtcggttcacaggtggtgcatgcctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtagccgtaccggaaggtgcggctggatcacctcctttctaagga

SEQ ID NO: 6 - DNA, 1504 bp, Propionibacterium acnes
acgaacgctggcggcgtgcttaacacatgcaagtcgaacggaaaggccctgcttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgtaaagggctcgtaggtggttgatcgcgtcggaagtgtaatcttggggcttaaccctgagcgtgctttcgatacgggttgacttgaggaaggtaggggagaatggaattcctggtggagcggtggaatgcgcagatatcaggaggaacaccagtggcgaaggcggttctctgggcctttcctgacgctgaggagcgaaagcgtggggagcgaacaggcttagataccctggtagtccacgctgtaaacggtgggtactaggtgtggggtccattccacgggttccgcgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagtgctcagagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagttggagtcgctagtaatcgcagatcagcaacgctgcggtgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtagccgtaccggaaggtgcggctggatcacctcctttctaagga

SEQ ID NO: 7 - DNA, 1504 bp, Propionibacterium acnes
acgaacgctggcggcgtgcttaacacatgcaagtcgaacggaaaggccctgcttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcagtgatacgtagggtgcgagcgttgtccggatttattgggcgtaaagggctcgtaggtggttgatcgcgtcggaagtgtaatcttggggcttaaccctgagcgtgctttcgatacgggttgacttgaggaaggtaggggagaatggaattcctggtggagcggtggaatgcgcagatatcaggaggaacaccagtggcgaaggcggttctctgggcctttcctgacgctgaggagcgaaagcgtggggagcgaacaggcttagataccctggtagtccacgctgtaaacggtgggtactaggtgtggggtccattccacgggttccgtgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagtgctcagagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtagccgtaccggaaggtgcggctggatcacctcctttctaagga

SEQ ID NO: 8 - DNA, 1504 bp, Propionibacterium acnes
acgaacgctggcggcgtgcttaacacatgcaagtcgaacggaaaggccctgcttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgtaaagggctcgtaggtggttgatcgcgtcggaagtgtaatcttggggcttaaccctgagcgtgctttcgatacgggttgacttgaggaaggtaggggagaatggaattcctggtggagcggtggaatgcgcagatatcaggaggaacaccagtggcgaaggcggttctctgggcctttcctgacgctgaggagcgaaagcgtggggagcgaacaggcttagataccctggtagtccacgctgtaaacggtgggtactaggtgtggggtccattccacgggttccgtgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcggaagcgctcagagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtagccgtaccggaaggtgcggctggatcacctcctttctaagga

SEQ ID NO: 9 - DNA, 1504 bp, Propionibacterium acnes
acgaacgctggcggcgtgcttaacacatgcaagtcgaacggaaaggccctgcttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgtaaagggctcgtaggtggttgatcgcgtcggaagtgtaatcttggggcttaaccctgagcgtgctttcgatacgggttgacttgaggaaggtaggggagaatggaattcctggtggagcggtggaatgcgcagatatcaggaggaacaccagtggcgaaggcggttctctgggcctttcctgacgctgaggagcgaaagcgtggggagcgaacaggcttagataccctggtagtccacgctgtaaacggtgggtactaggtgtggggtccattccacgggttccgtgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagtgctcagagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtaagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtagccgtaccggaaggtgcggctggatcacctcctttctaagga

SEQ ID NO: 10 - DNA, 1504 bp, Propionibacterium acnes
acgaacgctggcggcgtgcttaacacatgcaagtcgaacggaaaggccctgcttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgcccggatttattgggcgtaaagggctcgtaggtggttgatcgcgtcggaagtgtaatcttggggcttaaccctgagcgtgctttcgatacgggttgacttgaggaaggtaggggagaatggaattcctggtggagcggtggaatgcgcagatatcaggaggaacaccagtggcgaaggcggttctctgggcctttcctgacgctgaggagcgaaagcgtggggagcgaacaggcttagataccctggtagtccacgctgtaaacggtgggtactaggtgtggggtccattccacgggttccgtgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagtgctcagagatgggtgtgcctcttttggggtcggttcacaggtggtgcatgcctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtagccgtaccggaaggtgcggctggatcacctcctttctaagga

SEQ ID NO: 11 - DNA, 20 bp, Artificial Sequence
  source: /note="Description of Artificial Sequence: Synthetic primer"
ggtatccaccgagatggaag

SEQ ID NO: 12 - DNA, 20 bp, Artificial Sequence
  source: /note="Description of Artificial Sequence: Synthetic primer"
gtggtcccaggtgacattct

SEQ ID NO: 13 - DNA, 20 bp, Artificial Sequence
  source: /note="Description of Artificial Sequence: Synthetic primer"
cgacatcgacgtttcatctg

SEQ ID NO: 14 - DNA, 20 bp, Artificial Sequence
  source: /note="Description of Artificial Sequence: Synthetic primer"
gtgttctcctcgtgctggtt

SEQ ID NO: 15 - DNA, 21 bp, Artificial Sequence
  source: /note="Description of Artificial Sequence: Synthetic primer"
gataatccgttcgacaagctg

SEQ ID NO: 16 - DNA, 19 bp, Artificial Sequence
  source: /note="Description of Artificial Sequence: Synthetic primer"
acccaccacgatgatgttt

SEQ ID NO: 17 - DNA, 21 bp, Artificial Sequence
  source: /note="Description of Artificial Sequence: Synthetic primer"
gaagaatcccgctccatttcc

SEQ ID NO: 18 - DNA, 20 bp, Artificial Sequence
  source: /note="Description of Artificial Sequence: Synthetic primer"
cctttcttgtagccgagcag

SEQ ID NO: 19 - DNA, 25 bp, Artificial Sequence
  source: /note="Description of Artificial Sequence: Synthetic probe"
attgtcacctgggaccaccgtaaac

SEQ ID NO: 20 - DNA, 20 bp, Artificial Sequence
  source: /note="Description of Artificial Sequence: Synthetic primer"
cgtgatcctgatcgactgtg

SEQ ID NO: 21 - DNA, 19 bp, Artificial Sequence
  source: /note="Description of Artificial Sequence: Synthetic primer"
gctccacaacttcgagtgc

SEQ ID NO: 22 - DNA, 22 bp, Artificial Sequence
  source: /note="Description of Artificial Sequence: Synthetic probe"
caggccgttgatcgtgagctga

SEQ ID NO: 23 - DNA, 20 bp, Artificial Sequence
  source: /note="Description of Artificial Sequence: Synthetic primer"
tgctgataatccgttcgaca

SEQ ID NO: 24 - DNA, 20 bp, Artificial Sequence
  source: /note="Description of Artificial Sequence: Synthetic primer"
acgacgtcgaaaacaactcc

SEQ ID NO: 25 - DNA, 22 bp, Artificial Sequence
  source: /note="Description of Artificial Sequence: Synthetic probe"
ctctaccgaagctcttgccgca

SEQ ID NO: 26 - DNA, 19 bp, Artificial Sequence
  source: /note="Description of Artificial Sequence: Synthetic primer"
atcgccgtcgacaggtagt

SEQ ID NO: 27 - DNA, 19 bp, Artificial Sequence
  source: /note="Description of Artificial Sequence: Synthetic primer"
ccgagattctgcgcctagt

SEQ ID NO: 28 - DNA, 21 bp, Artificial Sequence
  source: /note="Description of Artificial Sequence: Synthetic probe"
cggtgcccttgctgaggtaca

SEQ ID NO: 29 - DNA, 6363 bp, Propionibacterium acnes
gtgttgtggactctcggggtcagtctgtccgctcacttgagatggcttaacatttctgaccgacgccgaagtctacgaacgctgcgaaacgccaaccgacgcctttgtaaccaagccttcttcatcaagatctacatcgacgaagacgaccaactccgcgtcgagaacaaccgacctttcgaaatgctcctcgaccctcagatcaacgccaacgccctcacctgggcccagaacggcaacaaggcccgaatcgaaactaaggggttcgagccttgtgcgtggggttacttagacgttcattttgatacaaggatctgggtgggtgcacggaggggctaggtgggtgcattgcatcctgacaggagcgccgggtgagttctggttgactaccagcagcgtgttcggtatgctagaggatagttacgcgacagcgtccgttccaatttctgggagtgtgttaattccgatggtgctgtgatctccgttcggctacgccgagaagcgtccaaatgtttcgacggttttggggatcaatatgtctgctatcgaggtaatcaatctttctttttcattttccgctcagccactcttggataacgtttcattcagcgttggcgatagcgagcgcgcagtacttgtggggcctaatggctctggcaaaaccactctcctgcgcctgatacgaggagagctaaccccggatcgaggacatatcgccatcagtgatgcaggagatgcaggttcttgtcgcttcccttatgttcgtgacgccactggcacagttcaggactatctggacgacgtgttggctggcccatgggagttgctcactcgcttcgaccacgtgacgaagcaactatcggctgcccaaagttcagcgagtctcgctaaagagtacgatcacatactcaccagtcttactctggccgacgtatggtcgctcgaagctcgaatcgatgaagtgttagccggtttaggtctaggccagctgaccggacgcggtcgacagcgcgcactcggctcactctcccctggccaggcagtgcggctcgaactggcaggcatcattatggtcagaccagtaactctggtcttggatgaacccaccaatcatcttgatgacgaagccgtaggctttctgatccagcaaataacagattggccggggccagtgctcatggccagtcataatcgtgcgtttattgaagagacagccacggtcatctatgacctcgatattgccccgtggcaggctttggccacagctgaaggagaggctgtgtctggcgtgtaccggtgcactggcgcctatagtgattatcttggcgccaaacaacacgcccgcatggagcatcaaaagcttcacgccacccagcaatctgaaaaacgcgcgattcgaagtcatcgccgtcgtagcgaagatatcgctcgtggtggagtgaaattagcgaaggcgcagggcatggcacgtaagttcttctctgaccgggcagaaaagaccgcgctgcgacgcacgcgtaacgacgatcaacgcttacacgatcttgctgaacatgaggtgcgaaaaccccgcaactaccaacttaagctcaaccttccaccagtcggctcgcgtggcgggttagccgtcacggcacgaagcgccttcattccaggcaggcttctcccaatcacgttcgaccttgccacgggggaacatttaatactgactggcccgaatggagcggggaaaaccacgctcttgaattggcttgctagtgggaaaacaacaatcgaccctagatccgaagccagcggcactatctctgtcagcgggcggcttgcttacgtcccacagcgcctaccacgcacaggagattcctactttcacccagaacattggaaagacgggatcagagaacttggcacgggaatactccacccatccatgtgggccaccccagtcggccaactttcagatggaaaccagcgtcgagcccagatcgcgttagccgtggcgcagaaacccgagattcttgtcattgacgaaccaaccaactacctcgacctcgccacgcttgaagaactagaggacgcgctacgccaatggaacggcacactcatcatcgccagtcacgaccgctggcttatcaaccactggcagggaacacaaatcgaattatgccccacagatccagcgcccggatcaccgaatcccctcttactcgttaagagccggttcgagccgtggtagtgccgtccttgagtgtgagtttgatagcgccgtcgtggttgacggtggtgtgatcgacgagggtgttccaggcttggtcggagtattcgagtggtggttgggtggcaaggtagtcgcgtacttcgattgcttgtgctcggcggtggcgcagatcgtcgatctggtcgctgatccgttgatgctcggcctcaagttggtggtgccgatcttcaagctcgtggtaacggcggtcgtagtcgtcagggtcgtgggcggtcgtggctgcggggtgatgagttggttcatcagcgtgatggtttcttcgatccgctcccccagcgtggcctgcttggtttcgagctcgcgggtgtcgtagacggtttcgtcgagcaggcgcatggtgtcatcgagcacgtcgttgccggtgacccgcttagccagggctgcgacgaaggcgtctttgatctggtcttcggtgacgtggggtgtcgcgcagtgatgatccttgttgtatttgttgttgcagcgccagatgtagcggcggtatttgctggtggagtgccagactttccgcccaaacctcccgccgcaatcggagcaggtgatcgtgttggcgaaggggtgggtgttggaggtgcctttgcctgcgcggcgggcgagttctgcttggacggtgtcccaggtgacgggatcaatgatgggttcgtggttgctggtgacgtagtactggggtacttcgccttcgttgattttcatggtttggttaggaagtcggtggtgaagctcttttgcagcagcgcgtcgcctttgtatttctcgttggcaaggatcgaccgcacagtggagggcgaccagatttgtttgccacgcggggtggggatgccatcggatgtgaattctttggcgatggtttgtggggttgcgccttcgaggaagcgggcataaatacgacggacggttggtgcttgggtttcgtcgatggcgaggttgccgtcttcgcctttcttgtagccgagcagggacgcgtaggacaccatgattttcccgtcggcgaagcgtttacggtggtcccaggtgacattctcggaaatggagcgggattcttcttgggtgaggctggacatgatggtgatgagtagttcgcctttggaatcgagtgtccagatgttttctttttcgaagtagacctctacgcctttgtctttgagctggcggacgtggatgagggtgtcgacggtgttgcgggcgaaccgggacacgctcttggtgaggatcaaatcgatttttccggcgagggtgtcggcgatcatggttttgaagccttcacggtgtttggtgctggtgccagtgatgccttcgtcggcgtacatgcctgcgaattcccactctgtgcgggattggatgtggctcgtgtagtagtcgatttgtgcctcgtaggaggaggcttgttcttccatctcggtggatacccgcgcgtaggccgctaccctgcgccgacgccgagtaccctgcaccgtggtgtgtccgggtatttttgtggctgggatcgcggtgacacgcttgttccgaatctgcttggtggtcatatcgcactttcctcgtccaggctcaccgccactggcacttcgccgctaatggtgtggatggtgagcgtacgatcgggattgacaacgattttcacgaggcgcgtcagcgcatactcgtcgtcccagtcgtcgaggccaagcacgcgggtgcagatctgggtgagatgggtttctcggatttgtggtgcctggcagggattgcctttacctttggtggcggtttcgcaccaccaaaacttgtaggacgtgtggcggcgtgtcttggtgcggcggtgataaaacctgctacagacagagcattcaatccgagaggtgagcccggtcgttctagctgacggcgtggctccacgtccgagatgtctgcgccgggcgagctcggcctggacggcgccgaacgtggtctggtcgatgatgggcgggtgggattcgtcgacgaggtagcgtggcagctcgccggtgttggtatggcagttcaattctgcaacgtttggccggtaatacttttgcaggattacgcggccggtgtagatttcattttcgagccatttgcggatcgtcttaccgcgaaacttggctccccgcctaggcttgaccccttcagcattcaactgactgatgatcttggcttcagtctcgatgatagccaagtcactacccacgtattggtagccgtagggttggcgcgaatgcatgagcccgtcggcgtatttcttccttatcccccatttaacattcttcgacatggatcgagattcctcctgcgcaaacgatgccagcagggtcagcaggagttcaccgtcagcggtcgcggtatcgatctgttcacgctcgaaacgcactgagacgccgaggattttgagttcgcggacggcatcgagcaggtcgacggtgttgcgagtcagcctggatatcgacttcgtcaaaatcatgtcgatgtcgccggagcgggcggcggccatcatggtctggaacccctctcgacggacggtactggtgccggtgatgccttcgtcgatgaacacgcctgcatagtcccaaccaggggtggattgaatcagatgagagtagtacgacacctgggcggcaatcgaagatagctggcgttcgtgctcggtcgatacccgcgcataccctgctactcgtagccgacgtggcgtggcgggtctaggtgggataactcgaaaactacgcgaggtcactccctgcttctctttcttctatggcgacaggtgttttggttgtatccatctacgctctaaacctgagtcttatccagtcgaacctgcagcaacaatgcccccactggcgcggttgcttcatgcccgatccgcgtaaggatcacgtggctttcgtttggggtgagtgcgccggtttcggtgagccgatcaataaaggcgacctggcgggcaagatcgacttcggcattgaacatggcacccgtcacggtctgccacctcgggtgctgaagcggtgcctgatatagcaggcatgcgagcaatacttacggtgcttgtttccgtaggcctcgaagctctcaccgcaagcaacgcaggtgaaggtgtatattgcccgccggttgagccgttcggggtgggcgtgctaccacgacaaacgacacacatccgaacagaacctttgccccgccaccgcagcttcaaaatgcccattacagtgttcgcatgccttagcaggctcaacatcaaccgccggatcgatgttgatgtcagctctgcgacagatcgacttcaccgtattgcgcgacatgcccaatctggtggcgatctgcccatacgatgcgcctcggcatcgcagctccacaactcgctcacgggtaatctcacgtgccatgacgcgctcctgctcaatagaaataaggtctctactgacagggcttcgacccaccccgatttataaccaccactgtcctggtgcgatgggaacaaaaatggccccgccaccacctcatgtagtgaggcagcgacggggcgaaacaggacagttttcatgagtcttggtttagtggcggagtttttcgttgacccggcgctggacggcgtcgtagttggatccgagtctgcgtcggcgttcgttgccgttgccgtattcgccgcggatgaccgcgtcagcgagcgcgtcaatgttcggtgccggcttcggtgtgggtgcgggtttcggtgccggcgcgggtgcgggcgtgttgccggtcatgtggtcgtaccagtactgggcgcgagccatataggcggcgtgctgagtaccggccagcgatgctgggcattcggtggctgagaagtttttgtgcccgaacacgttcttaccccaggtagggcggccgagcttgtaataccgacagatcgcggccaccaaatgtgcgccgttgtcgaggcaggcgtcagagattttccatgggttagaagaggcgtcggcgtgctcgataccaatgctggtggtattggctgcccagtttccggcgtgccaggcggtgtcgcggtcccacacgagctgcccgatccgcccggaggtttctacctggtagtgggcggaggcgggccgggtctgccacac

SEQ ID NO: 30 - DNA, 20725 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 31 - DNA, 56169 bp, Propionibacterium acnes
tgccgacgccttcggcgtcgggtgagcgcgtggataggcgccccttcggggcacctgtaagcctgtatcgctgcggtttacagccttggccacccaaaggggcagcaaggggcccggagggggcattctgcgccgctgatagcatctcacatgtgagttattctctcaactatccttcaagtcaagcgtattagattatttatctagtactcttgacagtccgtctatcgggctatatatttataagcagaacgagagatcgggaaaggaatcaacgatgaagtacaccgcacacgtcaacatggtgaccaagccctacatcggacttcccactacccgaaccccctacaccctcgtcgacgccgactgggccacaacatggatgatcgacgaaacctacgaagcccactaccacggcaccagcgtggagatcagcatctacggcgaaggccccaactgctccgtactcaccaaccgcatctacaccgaccagcccaccgatgtgaccgctgcactcgccaactacggcttcaccatcgacaccaccaacacatccaaaaccatcctcacgctcacccgcacagccaccatctcccacctactagccatcctcgatggcctaccccaagccgaggggactcactggctcaacactcaacccgacctccaccacatcaccctcgacgactccaccaccggctgggccaccaaccgcaccgacgacaccgacaccggcgtctgctacgacaccagcacccacaactggcagatctgctgacagcataacgggcctgcccttgaagggttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactcccccaccctcgtgtagtacactatactacacagtcattgaggatagaggtgacgtcatgagtttttcgatccgtttaaccgaccatgagcgccgcttagctgattcctacgcccgcctgcactcgcagtccctgagtgaggctttcaagcaagccctcttcgaccgcatcgccgacgagttcgatctgcaagtagcccgtgaggcactcaccgactacgcccgcgacaactaccagtctcgccccatcagcgagctatgggacgagtgtgacctatgagctggcagatcgaaaccacgagccggttcgataaagaattcaaaaagctagaccgctacacccaaaaactcattcacggctggatcacgaaaaacatcgacaacaccgacgatccccgccgccacggcaagcccctcaccggtgatctttccggactgtggcgctaccgcatcggcgactaccgcctcatctgcacactcaacgataaccgcctcaccatcctcgccctgtccatcggtcaccgccgcgacatctaccgataagccgttgcaagactgcggcgtcgacaccgccgggaccctggcccaggccttgggcctggaggaggacgagagcgaggagcacgccgcctgagcggtcgccggcacttcccataacagcaccggtcccggcggcccggccccgcgtctggtgctcggaccgatgccggcgcctggcctccgacgcccgccggggccagcggctgggctacctcgacgtcgacgtacaacgggccgaacgaaccgtgcgctgatttaccaccgcttccgcacagagaacatgcctctgactaggagaaatgacgttttccacagggcctctattactaatatccctattatctctatccacgcgcgcgagcctcagcgttcaagcttcaggtcttgctcgtctccctcgcgcctcgctgcgctcgttgctactgccgccccacccggcaagccgggtgggttgccatcggaataccgtggaccatcccggcgcatacacccagacggtccaagatccaatccacgctcacccgcgacgccgctaacgatcctcatacaccgtagatgccgttctgagagccttccagacccgcacgtgggtttattgcaccgagacccaaatcccctcagaagcgatcctgaaaccgtctacgccccatttccgacggacgctggacaggctgggcggcttgtctcccgccgcagacatggccctggcatatgcggttgccgactggtgggatcagggattggatcacacggcagacggctggtccaaggcgggtgtgcaggtgcggtgagcggcagacgtgaccggtggggtgcactgtcatggccgggcatctgccgagccaccatgcgggccctggaccaggaggcagcccgctgcgaggactgggggaagacggcggcacggatgggccgtcgggatgcggcggccgaattcaccgagactgcggtgcagcatcgtggacagatgcaccacctcatgtcggcacaaaaagtgtgggtgtcgaccgacatggtgtcggctacactggacgccgcaggagacgtgccgagtttcgaggccgtcgacgtccctgccgccgggctcatgggtttggccagccccctgccgccggttaccctgcagcatccgctgtatctgcgcagcgacgagggtgtgacaaccttcactgatccggttctcgtcgacgcgctgggatggtggatggattctgggcgtgtgcacgtggtgatgtgcacacgcacaccccggctgcccaacccggtttatgcggtggcctccccactgacggtggtggagaaaatcacggtgcccaccggcatcgagttcgagaccatggagtccaggatcctgacccccggcggcgtgacaggcgtctcacggcagggcacacgcatgatgatccggttggcgtcatggctgggtgccgcgtgggtgctcatggcgactccgacggtgtcggagccgcaccctatggatggccggtggggaggcccagcaacggggcagacccggccgcgtgatcgggtgaccgtggtcgacatgcggcccatgaggcaggtgcacaccaccaccgaccccaccggcaggcggttgacgacccggcatgtcgtgcgaggacactggacacaccaaccctacggcccggcccgcagtctccgacgcctgcagtgggtcgccccattcatccgcggccccgaaggggctccgttcgtcggcaccgacaccgtcaccgtatggcgccgctagatacgcgggcgcggggggttgacgaacgatgcccccctctttgtgttgtgatcagtcgtgatcggcgggttttaggtcggggtaggtgtcgagaatggccttgaggacgaggtcttggattgtggtgtcattctgggctgccttgaccttcagtccaacgccgatgtcccgggggattctggtctgcaacttgaacaggtctgcctccttggttttgaacagtttggctgcagggttggcaacgggctgttcttggcgctggcgtccaaggttgcttttctttcgggcggtcatgacatcatctccaacagttcgtcggcaacatcggcgaagaaggcgatagtttccggctcaggggtacagccgtaggcgcgcttgatgacttgacgcttggggatgacgtgatcgaccaactgcgtctgggagtcgttggctagaaggtcgcgaccttccttgaacagggaggtattcggttcagctttggaaagcagcaccacgcgcggggttcctgcggcggcgtcgtgcgtctcccaggtgcgcgccatgtcgagcccggacgtgtcggtggggatgataaccagatcggcggcgcgaatggcggcggtgatgatgtcaccgttgcccggcggggtgtcaatgatgacaacttcttcgggtccggcgacgaggtgctggagcgtcgccttgttggccggttccacggggaaccccaaggggtcggcgttactcagtgtgcactcggcccaggatgatgctgacccttgagggtcggcatctttgacgcggaccatacggcccgtctcatggagagctgcagccagcaggatcgctgccgtggtcttaccgacgccacccttggcgttgataatgctccagatcatggtgacacctttcagtgaggatgcatatcagtttacctgcaaggagtaaagacggcaagcagttatgccgtttctgcggcaagccgtcttgcatccttggatgtatagatagttgtctacttatggttgtggatcgtggtgtctcgtaccaggatttagtgtgctcgctgatatgcacgactttcgggcggcctgatctggcggtggtgccactaacccaggagtctgatccgcaaggtgtcctcgactttgaggaaggggtctctgctttcgtgttgacctaaagtcaacggccctgggcgatcactgaatcctaataactttgtatccttccctgattgcatcttagcatccttgaattcaaacagggatggagccatgctgttttgacgacatggatgcactggggtttggttgttgccgatgcggagcgtcaggcggcccgggacgccgccaccgccgacacgctgcgggagatcgtgggactgctgggccggggcggcgaggtcccgcccgccaagacggggcgtaagacgaccggcaggccggccccggcccgcaagtcgtcggccacgcagtaaaggcagggatccgtccctacgcagagagcggaggcagatcctgggggatccgactcttcggttccgtgatcttcccggagatcttcccggatcccccagggctcatcctgatacggggtccgccgacggaccccgtatcagtgggggcgctgccaccagtgatggcgggcgggtcggtcggcgtctaggccccgcccgatggtcgcctggtctacctcgcaggcccgtgctgttgccgaggccgagaacgtctgcccacttgttgccgattcagtcccctctccgtctgccatgtcgccaacctttcctatctggcgtgctcatggacatgcccgggcacgccctcgctgctcagaggcctgctcgttccacctctggccgcgaaccgtatttctgctgaccactcctcgtgcgtgaatatttgccagccttggccattcatatttggactactctgcaccagatatcggactgggaaacctcttgcacatctctaattgtcatctattcgttgggcgcgcgctgttagatcgtgatcataccaatcagaagacaaagcgacgcccttttgagcggcttttcgaacgattctagaccgcgctatatcagcatttctaccgcgcggccagagtgctacactaaattcctctctgcaatccttaagtccattctttacttcctcatccaatttctgcgacagcatttttatggaagcatcgcactctgactcatcatcaaatgcctcaattgcgtgcgttcgccattcacggcgcgtattatcgtagccgtaatgaagtattacccaccgatccacagaatcatcgttaggatctacaactgtcatgaatggcccaactctcgctctggtgtattctcaattgcagttcagtgactttacttgaccagtcccggatttagtagacgtagacggagagtaccccgccgggaacttgactgacatcactgctgtaccgtactgctttcccgggtggcaaccatcgtaagcagcatttgccgtgacgtacctagtgctctttctctgagtgccggtaatcgccttatatggtacaggtgggtgaatcgtagccgttacggctaccgatgacacgtttgcatcacatgaagctgtggcgacataattagttgtcccattgacatgatgagagtcgtggacatactgtcgaggatcgagagtgcaggttattgttgacgccgttgttctggtaccagctgctttcgagctctttgttgcagttacagtctgcggccctgaaggttttactgacgcgactgatgtgttcgcgtgttttgcggcagtgctttgatttggttgtgcttgtgtagcagttgctgatgtcgccagtgatgcccccattaccatagctgtgattatggcgtagtctttacgcttcattgcgcccccaaataagcatgttagtttgctattttgaataggaaacgagacatcgccatgacttgtcaagggcagaagtagaaagaatcggggggtatcaagaaagatgtgctttcatcaggacgaaagcggatgggtccgttcgacttggtgacgaatgatccggccttgcgtcgcggagaccaggccggcgagtttgtcgagcagggccgccgtggcctcatcgtcgggcacatcactaaagggacgaacaaccatgacggctagggccagaaacgaccggaactgaatcgcatgtggacccccatctggcaccaggcacacacctaccgaccggaaaccctgcaccctgtcgctcccagttcacctcctaatatgcgcctatagtctgtgctagtagacattattttgtgtgttgtttcccatctggcatgtctggccccggacccgccgcgacacgcggtggtggataacagaccaggacccccggaccatagagaccagggggacgagacagtcccccggtgaggatgtctcgatgtgcagatcaggaacagaatcgccgggcacgacccggcgccggtgccggtgcagtgaacccgtggcccatcgactccacgaacgaacgtctcgccttcctcaactggtgttggcggcaaggctactcagcagccatcgtggaaacgatggacgccgcgggagcctacgaccacctcgacgacgaccagaccagcaaccagcacgactaacgccgctcccagcacgggggaaggcggcgcaccaggtgcgccgccttcccccgtgctggtgtctcgtcggcttactggtgggggtcgtaggggaacccgtaggtgtgttccagggccttgcggagaaggtcgttcatagttgtgtgttcggcgacggccttcatcttcagcgccgtgtgggtggcggtgggtagcttgacgttgaacgcggtgatcggggtcttggccgactggaaggtttcagagacactggctccctggctggccgccatttggtcggcgtaacggctggctttgtcggcggcggtgggtttgcggttcttactcacttcagcatctccttgattcggtcggcaacctgggcgaactctcctagatctgttggccgggttccgatggcttgccgataggcgacccgtcgatgaacctccgcatcgagaacgtctaggccctcaacggcggcggccccctcgtgggcatcacggtattgcctggtccaatcggctttgttgaagagcagggcccggcgtgtgccgtgggccacctggtaggtcattagcgctcggtccatgtccaggtcccccgactcggtcgggatgatgaccacatcggcgatgtcgagggctgcggtgatcgtctgagagtcaccggggggagtgtcgatgatgacaaggtcggcgtcgatgtcacggcagcgcctgacgataggggcattagccgggcggacctcgaagcccagcgggtcaccagtctcgaaagcgtcggtagcccatgacgtcgccgatccttgcgggtcggcgtcaagcaagatgactcggtactgagctgctaaggccgttgccaggtagaccgccgtggtcgttttcccgaccccgcccttggtgttgacaatagaaatactacgcataaatacatcattacacatgtgcatcgatgtatctgtatatatgtgtatcggcgtgttgtgagggaaaacccgggccacatacaacgatcccccagccaccacagccgggggatctctcagtaaagccagcaactcccacagaagttgcacccccacgatacccaccacatccgtgtcaagcccccacaacacccaccagcgccctaggcttcccccatgaacattgacatggacacaccaaccgaaaccgaagccgacaccttcgatgccgtcctcgccgacattaaccacatcaaccgcctcaccgccgacgaaatcgagtgctactccatgggagcctgtctcctcctcctcaaccaccaccccttctccgaactccgccaacactgggccgacaaccccaccgacgaaaccacgtggaccctctacggggccatcatcgccgcctccaccctggacccccacctcagcatcgacgccctagcccgcctctaccagctccccctcgacctcgtgacccaagccctcaccgtctaagcgtcgatgagcgggggagaggtagcgcactatcggctaaggaaccccacaaacaccaaacccttgtcactgggaagggtttggtgttatgctggtctcacaactcaacagaggaggtgagacatgggaaatgagtaccagaagtcgctcaaagtcctgttcaagaaactggaatctgagcaaggagcccgcatcgagacccggcgcaaaggatggatgatctacccgccggatacgtcacgatcagcggtcatgatccacaagactccatcagatcgcagagcatgggccaacatgctttccgaactgagacgctcaggattcaccgtctaactcagtgaagggggctggagctccagccccctttcaaccacctcccccggacaccacacaagaaaaggagaacatgatgtggcacgttcggttgtcgcttcgcgcaatcagcgaggacatgctgttcgacgccctggacaccctcgaccccttatccccggtggccacactgggccccgatgagcacaccggatcattggcggtgttcgtcgaggctgactcactgacagacgccatcgagactgcccgcacagccatcaccaacgcatgcaacaccgccaccataaccggcgtagaagcccgccccgaagacgaatgcttcgcagacgttgaccggcccctgttcccgccagtggtcggatacaccgaaatcgctgaaaccgcaggactctcacgtcagcgcatccgccagctcgcaggcaccgccgggttccccgcacctgtcatcaagaccgcggccggcccgctgtttcccaaagccgccgccgagcagtgggcgcggacacgccagcctaaggcaggccgcccaaaactccagaccaccacctcataacacatcccgtgtgctgaacctgttggccggcccagcacacacccccaggggccgggcccagcccggccccgccccacacccaaccgccccctgttgccgccgtggcgaaacgatcaggcgagccacgaccatcgccaagctgaatggagagcgagcatgagcaccacccctgccgggttcgacttcgacgctctggccgagtgggccgagagcgatgaggcgacccacaccccgcaaaccagccccgtgttccggggcaaggacgccgcgcgcgccagccgcgcattcctcggccgaggacggcccaccctcggctcagaccacgccaccggcgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcatgctttccggtgctgtcatgagcgtctgacaacagcgacacctcggggcagccgacggacagtcctctggctgccgctctgatcccatgcccacggcacgaaggtgtcggacagctcggtctcgtcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgccccgcctggtcctccagccacgacaacgcatcccgaaacagcccgacgtcttccaaagctaaaccacagtcgtagccgcccttgtcccccaaccgcacaatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacggtggtggggcaggtttgtgacctcgtgacgcagcaggttgcgcttgtgcatctgccgttcgagacgctcgggctgacctgttgacggggttgagccgtggcgccgcttcctcggcggggtctcgatccgttgctcttccggcggttcggcgtcaggttgtggtgcgcgatctcccctaggacgggggggctcgccacctatatccgagggacgatgagacggccttccacgcttgctgcgcactttcgcagcccgccccttgcggtcacatcgacgcggcggcggagtgacgtcctcaccgcgcgctaactgcgtcaacgccgccaccaggttggtgcccggtttcagccctttcagcacgaaccgcaccaggcgggggtctcggccgattcgtcgggcaatctcggcttggctccacccttcggctaacagggtgcgcaacaagtcttgggcccggttatcacgctcagtcactggtcgcctcctcggggagtcctgcctgctcggcctgctctgatagagcagcccgttccgatccggtctggggcgctttcaggggaccgggtaggacacctttgacacgcagtcgcccgtccttgccgtcgtcgccgcccccctgggccacagggagcgcccaggggggcacgttgctggtgtagatggcgtcgccgtggatagccagcagggtgcgggagttcatgcgtagtgctcctcccttggttgtggcgttttttccggtggtggggtcggcgatgggtgtgttgagggtgcgtacgcgggacagggcccagatacgggcggcgatttcggggtgccaggtgtcggggtcggggcggcggcgggcggtttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggttcttgtctgcccagcgtttctcggcgatgtcgatcatgtcttggatggttttgacccatcctcggatgggatcgactttggtcagtttgatccctccaaggaactcgatgggcttagtaacgggcccgtcaggaccgaattcggtgtcccagccttcgtcgatggctagtttcagttcggcggcgtcaacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgtgagcttcggtggcgctgagcagagtggcgggtgcggcaccgatctctccggtcactgatccggcatacatgaatcggccgtcgatgtacacgaagttagggatagggccggcaggcacggtggggcgccaaccttgttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgccgcccccctagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcggtagctgggcatgtcaccctcccctatctgtcaaatgagctagacacagtgtctatttaatttgacgcaaagtcaagtgcattagacgcctttgtgtggatccgccccaccagacaaacactcgcgcctcatgacccgccgcgaagccttaacgaaaccaaaccgcttatagaaccgctccgcagcgctccccgagggctttagctccaaggtaagaccttgctcgtcggcccattggcagacttgtgtgaggatctgtgagccgtagccctgatttcggggggcggcatgcacgcacatcagcatgtgaccatgacggcgggtcggcgggctgacataagccccaccacgccagtccggtgtgatctgccaacttcgccatgccgcagcgcgccagcggcgggcctcggtagccaccatgatcaccatgatgatggacagggttacgacgccgactatggtcagctcactccagccaggccagttcccggagatgatccagcctcccagcgcccagatgatcatggcttccacgcccgccgcaatcgggacgagtggggcagtacggatgcggcctgccatgatctcggtgatctcgctgcgatgccatgacaaggagaattcccacgactcttgaatcatgctgatgtgtgaacggcttcctcggcttcgccctgccatagcttctctagacggcgctcggctagctcgtcggggcacggcgacagcctgccgcactcggagcagaccccgaagtggcgcgagagagtgatgaccggctcatcgggagcatgaaccgattcaacgaccgggtgctgctcatcggtgagtcctgaggcgtgaccaatctcggctagacggaggtgaaccataccgtcgtagtagtcgaggccttcaacgtggaacgggtaggagccgtccgcggtgtggcctgcaaccaggtccccgacttccagctgactggcggtcatggttcgcaccggcggcagcggggtccgggtcgcgttgatcctcatggtctctccttgcttctgcgccttcatagatgaaggtgccacagccggggttgatgtgcggaaccacagccactttttcaataaatccatcaccacggtctcaccccttcccaaatgtgtaaaccgtggtttacgctttaaggcatgatcgaacacacaccgacacccgccgcgcctcgcgtggccatcatttcccctagcgggccaccacggttcttggccgagcctcccagcgccgcgctgcgacgccatggtcggacccgcatgaggtcccttcccctatcccctcacattcgcgcctgggtctccaccagcggccgtaaacccaatcccatagccaccgccctgatctggatgcataccggagccctgctgccggtgtgggacaccgccgttttgactgggcctgccctcggcagacgtgtgcgccctctcagcagtgacgccgaactgacctctcggcggtggctcgaccaggttgccgaccatcccggctttctcgacacccttatcgaggccgcccgcatcaccgatggatggcatcacgcgacgcctccgcacattcaggccccttaccggacccttcatcagtgaacggaggtacaacgacatgaccagcgacattgacattgaccggacccacaaacccgacgaccgcgccgaggctcctctttaccggtcctgggccaggagactcgtgcacgtctccgggatgccctggcgtatcgtcgccgccttggccggggtctcccccacctccatgcaccggcttctattcggccgcaacggtcgacccgtggaatggatcggcatcaatgatgctcgcgccctgatggatatcggcatcgatgatctcgcctcagcgtccaccgaccgtatcccggcccgcgaatcccgcgagctgttggtagccctgcacaccctcggctggaccgatgagcatctaagccgctggctgaccagttccgacctcgacctgaccaccgcccccaaagccctctacgtcactcgactatccgccgcccgcatccaggccacctacgacatgctcatcagccagcccgtccgccgctgcggccacccccgcaccccgcccgtctcgtccccgacccctgctgtcctaccccagcccagacccaacaacaccgaaccgttccaacccgccctgttcgagctggccgactgcgcatgaggaccctgcacagacgtgattaaatcgaagggctcaaccagtcatcaggagtcccccgtgcgtttgtaccgcgctgttctcgccgacaccgacatccatatcaccatccgtatctggaacactaccgatcgtgactggacctgggccccccttgacacttgggcccccgacccggccccgaccacaccagcccagttagccgatgaacttcaccgtcacggatggatcacccctgaggtccctactaccctcaccgaggtggctgtcatccccgagaactggcaagctttcgtcgagcatgccctcgctgtccggaaccagcaggctgaccaattgcgcgtcgccgagaacatcctcaccgacatcctcggcgacgccgccgacgccggcctgtctgtcaccgctctcgcccgcacgaccggactatcccgagtcgccgtctacaaacgcagcgccaaaaccatcgactccatgagacacgccacccaggccggcggaatcctcaccccctcctgtctcacccacgctgagagaacagcgctcggcctgcccgacgagtaacccatcgtttacatcctcgactggtccctgcgaccagtgaaccgtgcccccactgcgcccacaatgatcagcacacccacggcgatcatcaggtgggcagcactaactgatcccaacgaaccaagatcaaacaagccctgcccgggagcgtcgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgccttgtcttcttgcccgtggcgcttccgagatggtcagtgggcgatggctaggccgatgagggcgccgctgcacaggctgggcgcccagggaaggaatcgggtggtgtggtgtcggaaccggtcgattagggcatatagggcgatcagggtgaggccggctatgacagtgacctggatcgtgtcgatgccggttgctgcggccggggctgcccacagtggtgtgatgcgcacatcagagaaaccgaatccgcctcgggagatgagccaggcgatcatccacgctgcgaagatgatggcggtagcgatgacagcacgtatcgccgcagtatggtccgagagggcggtaacgactacagccccgatccatccggcccatccggtccacgctaggactgccggtatccatgtggtgatggcgtcaatgacggcaacccatgccccgatggtggctagcagagcccaggccggccaggtgggtgctggggcccacgctacggcggcgatcatggttgtcgcagatgcagcacagacagcgatcaagcttcggaggctgtaggtgtcgcggtagacgatcttgtcgggattggcggtagctggttctggcaggacgcgggtgagggcaggccatcctgcgaccgcaatagccgcgacggcgaccacccacacaatctgttgcatgggtctcatcatggcccatcatcgatgagtatgggtggccgacatggggtcactcgtagaggggatcgaggggtgtgcgggcgagcatggcttcctgtgtgccgagcatgagggtgccagaatcctcgccagccgattcccagtcgacgatgacctggtcgccgtcaacgctggattcggcgatggtcacccattctccgtcgatattgatgagcaccccagcggccagctccgtggcagcaaccgggtgaggtgggttgtagaagcggtcgatgtcgcaggcagggtcgtcgggttcctcgactaccggaggtggggtcgatctggctgtctcggtgtcgtcggccaggtcggctcccaggatgcgctcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccacgagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccaccgcggtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcataatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgacgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctttcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacagatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcaaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcggtattcccggtcagcatggcggttaggaagcctgaagaggcttgggcggccgggtcggcggtgcgaagctccgaggtgtctagggtgggggctgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatctgtgcatcgatatacctatgtatctgtctgtggtttttagaggccactcccgtcgccccgggccgctcagcgataccgcaaggctgtgtgggatcagctgtgccgctctcccgacatggcagacagcaccctgcggactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcgtatcttctagcaattgatctagctatgtatatagctgatgatctagctaccatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgtcgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactgatgaacaccccagcgctgatagcagccctcatcgtgaccggcctgggactgatcatggccatcaacggcctgatcccggccacacccaaacccggcaccacgctgacgctgtcacagcggtgggcccgggccacccaccgcccagccggggcagccgggcgccgacgcgacctgcgctgggcgctggccggtctcgtcggcatcgtgctgttcgtcctcacaggttgggtcgctgccctggccctgggccccatcaccgtgctgctagcacccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgaatggcgcggcgggtgctgcggcccgtgcggcgtcgttggagcgtgatggacagtcggctcagtctgcggcgcagcaggcggcgtcggcgaacctgtcgtccggtgggctggcatgtgcgccgaatgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccggcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtgacggcgcccaattccgtcgtatcgccgaagcctccggtatcgacccgcactcagagctgaaagtcggccagaaactgatcctgccggttcctaagaacacggccgcagttcattcggttaaagcgggggagtatctgtgggagatcgccgagcactactacggtgacggcgcccagtaccataaaatcgctgaagcttccggtatcgatgcccattccgatctagccgtgggccaaaaactcgtcatccccgggcccctccgccacgacgccacgccgccacaccactcggcgtcgacccacgcgaaggccgccaccccagcccacacgcccacgcgacggcctgcgcctgcccacaaagccacgcccgccccgacgccggccaccccaactactccgacccacacggtgaccccagctccggcctctgccggccactcgaccagcgacgagcacccactccatacggataccgccgcagcggacaaggccagcaacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagctcagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccaggttcgcgtcgacaccaaccaacccggcaccgacacccccttccccatcgacgacatcgacccgctgagctccgaccatccggtcctatccatcatcggccaccccgacatcacaggtgccactggaaccgttgggcgctccccgtggcgctgccaacagttggctctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggggacctggggctggcccggtgggcgttgacccaagggctactggtgtctcccgatcatgaggacctggtcaccggttgtctgcgcaccgagtaccaggccggcaacatggacaaggtttccgagctggtcgatcacctgtcggctaccgcacgacgcctgggcgtcgatttgagcgccgacaccacccggatcatcgactccgttattacccatacacgcaggagagcatcatgatctcccgttgcactcatctccgtcaggaaggttcctatgcaccattatcgtcttggtatcggcactgccctcatcgcggtagcagccgtggccggctgtcgctcaacagactcgacacccacaccacctccatcccgtgtctccgccacgacatcagcgagctctaccctcagcccgaccccgtcagccggagcgatcagtgccgccgacgccgaaaacatctaccgcaccgtccaagctaacaagatcgcactgtacaaaaagggtggcctggcacccggggaacccgcacccgcgacactgtcgaactacgccaccggccaggctctcaccgactacatgacctacatgcaccaaatctcggggcagggcatcaaaatcacatcggggaactcctcggttaccgcggtgcgggagaaaaagggtgataccacctaccccgaagccgctatcgccttggaatcgtgcgaagacgacagttcgattcgtaccgtggaccgccacggaaaggctgatcatggacgcattttccatgtcgacagttggtatgcccgcgataagaagggcaccgtcaagatgatcgcattcaactcaacggaggtccccacatgcgacgtcaagtaatcaccgcggccgtactgggcctggccctggccaccacctccctgcccgccctcgcaggcggcggcgacttgaacggcagtgtggacacggatggccctggttacgatgtgcgtactgaggtggattaccatcacaccaccggtggtgcgggtgggggtgccacgacagggggccatcatgggggcaaaacccacggtgatggtgaaggtgaggctattgatgggcgttctcgcgccgatgccgaagccgaactagacgaagccgaccgtaaccaggacttgacttgtgatgtcttgctcccaccggcgccgaataccccagccggccaggaatgggcgaaagaatgcaatcccccagcgaaaaaggggcagaaggccaccccgaagcccgatccggtgttagtgggccgtcacgcggccttgcagctcacccttcccggcgcggcccctcgtatcgatccgtcccccgaccttaaccggtggcactcggcagcagtgggccaggctttgtggttgtcggttgatgaccccaccgccactacgcagaaatcgatcacgtttatgggccaggttgtctcgttgagcgccaaacgtaacggtttgtcgtttgatatgggtgatggtcatgtcgtgcactgtgatgccacgacgacatggacggagtcggtggaaccggggaccccctcacccacgtgcggttacacctaccaacaggcagccccggccgggggctataaggtcaccgcaatcacgtcgtgggatgtgacctggtcggtactaggacacacgggcacagtccacatccagaaggccggtgggcagatgcttccggtcggcgagttggagtctgttgttacacggcgatgactcctgatagtccgacgctgtatgaggtgttggaggtctgccctgatgccactgatgaccagatcaagacggcgtggcgtcgtgccgcgaaagtgactcaccctgatgccggtggcactagtgaggcgttcgcggccgcccggcacgcctgggaggtgttgtctgatcctgcccggcgcaccgcctacgatgccgacctggcgggggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcggtgacgggtctggcatttttcaccatggcggccatctggtgtggatggtcgttgataggtggtgcgttgctgtggggccagacgtcggtggtgtggctgattgctgcggggtggctggcatggctggtgtgtgcgtgggtgtggtggaaccgtcatctggcgtggagtagcgagctgatgcaggaaggcaatttgtacggccttcccgaggaagacccgttgtggggcgaggccgtggagctggtagcgggacttatcccctctgtgcgggcgatgtggtcgcacgatgggcagaccgtgactgtgtcggctggccggcgggtggcgacactggggatgccgatgcggggatggcgtggtatcgagatgcgcggctggaatccagtgggcgccgatacgtggtggatcgttgaccaggtgggtagttggctggtcgatcaggatgagccgatggtcgttgacgggagggtgctccatgaggcgtgggaacggtcgcagatggtccgttcaggccgctgagaaaaaatttaggtccgccctgcatatcggggcctcttcataccttcaaaagtgtgaagggaatacagactcttcgactggaattaaaatggtatatggcgtgtccggtccgcacccagctccacgatgcgccataggggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgacgtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaaggttctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagatgcgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagacctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctcccggagggcgtcatgaccgctttaattcaagctctgccgacagctgaactgtctgctggacctggtgctagcagtccagctagaccctctgctgagggcttcatcaagattcaccacgacctcattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggcccggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcgatgctgaggtgggctctggtgaaggtgtcgaggagggcggggaacccctgtcgattttgtccacccacccctgtcgattttgtccacccacccctgtcgattttgtccgccaagtattagacaaaccattagacagtgaattagaccctgggtcgcgtcagcgtgtgaactcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcagttcgtggggtggtgtcctcagctggtaggggcaccgaagaaggtgcgtggccagctccgccagatggtcgctgccgagatccgccggaatccgggctggctggatgcgccagcgttggaggttgttgcccagcgggtacgtgctgaaggtgcgctgggggtccagcactgtgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccatcaggcccgagacaccctcacccacgacaacccccatgaacgccgcctagcccgtgacgctgaacgcgcccggctcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacgcacaccatgaaacacgacaagccacctgacagtatcagctgcaagacgcatgacaacatagaaggacatgatgaaatacacatagacacaaccccgcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaaaccgacccattcgcccgccagaaagcagcagaagaccgcgcccaccaactccaagacgaagcccaacgccacgcccaccccaaacgcgtcatcggccccaccgcacgattccagttcgtcctgccagccgacgtgctcaccggcctcaaacacctcgccctcacccgcggcaccaccgcccgccaactcaccctcgacgccctcgacaccgcctacggcctcgacaccctcgccaacagcgggaagaaaacccacccatgacccgtgggtccccctgccaccaccccctcgacggcaactgtgtgcgagccacaggcccgcacacaggcggcagcccagtgccgtccccgccaggaaaggaactgaacttttctggagtgctggctccctatcaccccttatggtgctatcagatccagtagcgccagcccgagaggaaacccatgagctacatcgtccgcaccggaaatctagccggcacccccgagctgcgcgaggggtagccgacacggcggaccgtgcccctgacagtaagcggcactactggagacatcaccatgaccgctcagatcctcgccccgtgcaaccagaaggctgccgtcatcgaaggagccctgccatgaaccaacctaccccccacaaggccgacgagtcacagacgagcaacaccacgaggaagtggcggcacaaggtgtcgttctaccaagacccggccgacaccgaccgagtccgcggagcgatcctccacaccatgacaaccgaaggcaaccggaacctgagccagttcgtcaacgatgccgtcatggccaaggtgaccgaactggaagcaaaatacaaccacggcgagccattccccgccgtgggagcccgaggactcccccagggcggcgcagccgccaacagataagagggcggggaccaccaatagcagtcgatttcggatccagatcgggtagacaggacccatgatgaatttcatatcctccctgctctcggccatcctgaccctctttgcgatggtagccgtggcgataggagtggtgaacattgtgccgggaatatgcgccatcatcggtgcacggaaatacggcgaccaggaccgtgtgcgggcaggacaacgaaagatccttcttggtgctatcgccttggtggtagcagtaggcattcacccgtgacccacggttaccggaagccccgccgcaatcgataccactgtcagtaccatcaggggcgataggggtcaagctctccttgtcacaatcccttccccggcagcccagtaaccgtcgcttacagccatacatggatatgcgcccattcgtcggcaccgacgccgtgcgggttggcgacgctgacccgtctgctcacaaacgacccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgaggccaggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtaaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtggggatgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctggatcaggggtcgcatcgagtcctcgcgcgcccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagccccgacgagacgacgcctccgcccgccacaccaacggtcaccgccacggccacggtgaccgtgaccgtggcaccgaaacccaagccaaagcccaaggccaagccaaaggtaaaacccaaaccgaagcccaaggcccattcatgatcgcagtgcccgatacaaggtggagcggcccacaccaagctgggccgccaccttcgttttcgggacaccctcggcaacgaggcggcgagcgcgggcaagctggccctcgctcaatgccggtttccggcctcgatagcggccctgcttcttcgccaccgcgatcccctcggcctgtcgttcatggatcaacgcccgctcgaactcggccaaggcacccagcagatgcaacatgagctggctcaccggatcagcggaccccggcccatagacctgcccttcaagggcaggcccgttatgctgtcagcagatctgccagttgtgggtgctggtgtcgtagcagacgccggtgtcggtgtcgtcggtgcggttggtggcccagccggtggtggagtcgtcgagggtgatgtggtggaggtcgggttgagtgttgagccagtgagtcccctcggcttggggtaggccatcgaggatggctagtaggtgggagatggtggctgtgcgggtgagcgtgaggatggttttggatgtgttggtggtgtcgatggtgaagccgtagttggcgagtgcagcggtcacatcggtgggctggtcggtgtagatgcggttggtgagtacggagcagttggggccttcgccgtagatgctgatctccacgctggtgccgtggtagtgggcttcgtaggtttcgtcgatcatccatgttgtggcccagtcggcgtcgacgagggtgtagggggttcgggtagtgggaagtccgatgtagggcttggtcaccatgttgacgtgtgcggtgtacttcatcgttgattcctttcccgatctctcgttctgcttataaatatatagcccgatagacggactgtcaagagtactagataaataatctaatacgcttgacttgaaggatagttgagagaataactcacatgtgagatgctatcagcggcgcagaatgccccctccgggccccttgctgcccctttgggtggccaaggctgtaaaccgcagcgatacaggcttacaggtgccccgaaggggcgcctatccacgcgctcacccgacgccgaaggcgtcggca

SEQ ID NO: 32 - DNA, 26620 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggggaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacagattcctcgtcctcgacggtgcgcaccgggcccaagcccaccagtactgccatcgatctgagatccgagcccgcctccacaacctccccctcagcgcggaaataccaggctggagccactccataccccgcgatgcagcagcgaaactggctcacctactcctccccgtggacgctctcggtcaggcggaaatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcgcccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctggccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacgcctgcgcaggacgctttcgcccaagctgctcaagacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagccgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatactgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcggaacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccgcacacccccagtaccgagaaagaaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccgtcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgattcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggagagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggaatggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagatggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctccactgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcgaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggcccggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaaaatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccgatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattagtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcccccatccaaatcttcgcgcgctcatcagccaggccgcagtcgaggacatgatgggaaatccgactggtttaccacatgcctggaacctcgaggacatgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctgtgcggaacactgatgtggccttgccgaacggcctgttctccggttgggagggaatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacgccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccgccgactcctgacgcacggcctcctcgaccgcccggctgagcagggacccggccctgaccatcgacgtctccgggtccggctcgagatcggacaacgcgatgatccggtcgaacgcggaccgtttctcctcgggcaggtcacagcgtccgcacaccgcccagacgggcaccccggcgtcccgggcgatcttgcggatggtgtcgggaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 33 - DNA, 29140 bp, Unknown
  source: /note="Description of Unknown: Bacteriophage of P. acnes"
agtgaaatacctcccttttgtggatttgtctgtttgtcgactttttgtgttggtggtgagtgttgtgcagcctgagcttcctgatagtcgcgattggtgtggggagacgcgtcgttggtggcgtgtgtggggtgaggatagtcgcgcgcagtacgtgtctgatgaggagtggctgtttctcatggatgctgcggtgattcatgattgtgtgtggcgtgagggccgggcggatttggtggcttcgttgcgtgcccatgtgaaggcttttatgggcatgttggatcgttattcggttgatgtggcgtctggttgtcgtggtggcggttctgcggtggcgatgattgaccggtataggaagcgcaagggggcttgagtaggtgtctggtgttgtgggttctcaggttcctcgtcaccgtgttgctgcggcgtattcggtgtctgctggtggtgatgctggggagttgggtcgtgcgtatgggttgacgcctgatccgtggcagcagcaggtgttggatgattggctggctgtcggtagcaatggcaggcttgcttctggtgtgtgtggggtgtttgttccgcggcagaatggcaaaaacgctattcttgaggttgtggagttgtttaaggcgactattcagggtcgccgtattttgcatacggctcacgagttgaagtcggctcgtaaggcgtttatgcggttgaggtcgttttttgagaatgagcggcagtttcctgacttgtatcgtatggtgaagtcgattcgggcgacgaatggtcaggaggctattgtgttgcatcatccggattgtgccacgtttgagaagaagtgtggttgtccgggttggggttcggttgagtttgtggcccgttctcgtggttctgctcgcgggtttacggttgatgatttggtgtgtgatgaggctcaggagttgtcggatgagcagttggaggctttgcttcctacggtgagcgctgccccgtctggtgatccgcagcagattttccttggcacgccgcctgggccgctagcggacggtagtgtggtgttgcgtcttcgcgggcaggctttgtcgggtggtaaaaggtttgcgtggacggagttttcgattcctgacgagtctgatccggatgatgtgtcgcggcagtggcggaagttggcgggtgacactaatccggcgttggggcgtcgcctgaattttgggaccgtaagcgatgagcatgagtcgatgtctgctgcgggttttgctcgggagcgtcttggctggtgggatcgtggccagtctgctacgtctgtgattcctgcggataagtgggctcagtctgcggtggatgaggcgagtctggttggcgggaaagtgtttggtgtctcgttttctcgttctggggatcgggttgctttggcgggtgccggccggactgatgctggtgtgcatgttgaggttattgatgggctgtcggggacgattgttgatggtgtgggccggttggctgactggttggcagttcgttggggtgatactgaccggattatggttgccgggtctggtgcggtgttgttgcagaaggcgttgacggatcgtggtgttccgggtcgtggcgtggtggttgctgatactggcacctatgtggaggcttgtcaggcgtttcttgagggtgttcgttcgggtgttgtgtctcatcctcgtgctgattctcgccgtgacatgttggatattgctgtgaggtcggctgtgcagaagcgtaagggttcggcttggggctggggctctacgtttaaggatggttctgaggttcctttggaggctgtgtcgctggcgtatcttggtgcgaaaacagttaaagtgaagcggcgtgaacggtctggtaggaagcgggtgtctgtggtatgaacgtggacgagttggctctgattgagggcatgtacgatcgtatccaaaggttgtcttcgtggcattgccgtattgagggctactatgagggctcgagccgggtgcatgatttgggggtggctattcctccggagttgcagcgtgtgcagactgtggtgtcgtggcctggtatagctgtggatgctttggaggagcgtctggattggcttggctggactaatggtgacggctacggtctggatggtgtgtatgctgcgaatcgtctatcaactgcgtcatgcgacgtccaccttgatgcactaatttttgggttgtcgtttgttgcgatcattcctcatggtgatggtacggtgtcggttcgtccgcagtcaccaaagaattgtacgggcaagttttcggctgacgggtctcgtttggatgcgggtttggtggttcagcagacgtgtgatcctgaggtggttgaggctgagcttttgcttcctgatgtgattgttcaggtggagcggcggggttcgcgtgaatgggttgaggtggatcgtataccgaatgtgttgggtgctgttccgcttgtgcctattgtgaatcgtcgccgtacttctaggattgatggccgttcggagattacgaggtctattagggcttacacggatgaggctgtgcgcacactgttggggcagtctgtgaatcgtgatttttatgcgtatcctcagcgttgggtgactggcgtgagtgcggatgagttttcgcagcctggctgggtcctgtcgatggcttctgtgtgggctgtggataaggatgatgatggtgacactccgaatgtggggtcgtttcctgtcaatagtcctacaccgtattcggatcagatgcggctgttggcgcagttgactgcgggtgaggcggctgttccggaacgctatttcgggtttatcacgtctaacccacctagtggggaggctttggctgccgaggaatctcggcttgtgaagcgtgctgagcggcgtcaaacgtcgtttggtcagggctggctgtcggttggtttcctggctgccaaggcgttggattctcgtgttgatgaggccgatttttttggtgatgttggtttgcgttggcgtgatgcttcgacgcctacccgggcggctacggctgatgctgtgacgaagcttgttggtgccggtattttgcctgctgattctcgtacggtgttggagatgttggggcttgatgatgtgcaggttgaggctgtgatgcggcatcgtgctgagtcgtcggatccgttggctgcgcttgctggggctatatcgcggcagacgaacgaggtttgataggcgatggcttcgggtgttgcgtcgaggttggctgctaccgggtatcagcgtgaggcggtcaggtttgctggaaagtatgcgggctattatgccgagttgggtcgtttgtggcgtgtcggcaggatgagtgacacgcagtatgttcgtttgtgtgtggagttggagcgtgccggccatgatggttcggcatcgatggctgccaggtttgtgtcggattttcgccggttgaatggtgtcgatcctggtttgatcgtgtatgacgagtttgatgctgctgcggctttggctaggtcgttttcgactatgaagattatgaatagtgacccggatagggcgaatgacacgattgatgcgatggcggcgggtgttaatcgggctgttatgaatgctggtcgtgacacggttgagtggtcggcgggtgcgcagggtaggtcgtggcgtcgggttactgatggtgatccgtgtgctttttgtgccatgttggctacgaggtcggattatacgaccaaagaaagggcactcacttccggtcatacgcggcgtcataagcgtggtggtaagcgtccgtttggttcgaaatatcatgatcattgcggctgtacggtggttgaggttgttggcccttgggaaccaaatagggctgatgccgagtatcagaggacgtatgagaaggcccgtgagtgggttgatgatcatgggttgcagcagtcgcctggcaatattttgaaggctatgcgtactgttggcggcatgagataatttgctgtggtttccggttgtgcgccgccggttattggtgcacagggttgtctcccgcacgggggtcaacaatgttgtgttgttttccgcaaggagtgtagggttaggctatggccgatcagagtgttgaggaacagaatgttgacaatgatgttgtggagtccggaaaggataacggcattgttgatacagtaaaagatgatggcgggcaggaggtagccgacaatcagttgaagaatgaaggcgagggtaaatcgccggggactgattggaaggcggaggcccgtaagtgggagtctcgtgctaaaagtaatttcgccgagttggagaagcttcgtacatcgagtgacgattctggatctactattgatgagcttcgccgcaagaatgaggaactcgaagacaggatcaacgggtttgttcttgagggtgtgaagcgcgaggtggcttcagagtatggtttgtccagtgatgcgatcgctttcttgtcgggtggcgataaggagtcacttgccgagtctgcgaaagctttgaagggtttgatctaccatagtagtggtggcgcgggtgtgcgccgtcttgcggggagtgcccccgttgatgatgttaaacgacgtgagggtgtcgcgtttgtggatgctcttgtcaataattctaggagatgatttgtgatggctgacgattttctttctgcagggaagcttgagcttcctggttctatgattggtgcggttcgtgaccgtgctatcgattctggtgttttggcgaagctttcgccggagcagccgactatttttggccctgttaagggtgccgtgtttagtggtgttcctcgcgctaagattgttggtgagggcgaggttaagccttccgcttctgttgatgtttcggcgtttactgcccagccgatcaaggttgtgactcagcagcgtgtctcggacgagtttatgtgggctgatgctgattaccgtctgggtgttttgcaggatctgatttccccggctcttggtgcttcgattggtcgcgccgtggatctgattgccttccacggtattgatccggctacgggtacgcctgctgcggctgtcaagtcttcgctggataagacgaagcatattgttgatgccacggattctgctacgaccgatctggtcaaggctgtcggtcttatcgctggtgctggtttgcaggttcctaacggggttgctttggatccggcgttctcgtttgccctgtctactgaggtgtatccgaaggggtctccgcttgccggccagcctatgtatcctgccgccgggtttgccggtttggataattggcgtggcttgaatgttggttcttcttcgactgtttctggcgccccggagatgtcgcctgcctctggtgttaaggctattgttggtgatttctcgcgtgttcattggggtttccagcgtaacttcccgatcgagcttatcgagtatggtgacccggatcagactgggcgtgacctgaagggccataatgaggttatggttcgtgccgaggctgtgctgtatgtggctatcgagtcgcttgattcgtttgctgttgtgaaggagaaggatgccccgaagcctaatccgccggccgagaactgatttattgttgcggtgatgtgtcaatgtgcagggggtggtgttgatgggtatcattttgaagcctgaggatattgagcctttcgccgatattcctagagagaagcttgaggcgatgattgccgatgtggaggctgtggctgtcagtgtcgccccctgtatcgctaaaccggatttcaaatatagggatgccgctaaggctattctgcgtagggctttgttgcgctggaatgatactggcgtgtcgggtcaggtgcagtatgagtcggcgggcccgtttgctcagactacacggtctaatactcccacgaatttgttgtggccttctgagattgctgcgttgaagaagttgtgtgagggtgatggtggggctggtaaagcgttcactattacaccgaccatgaggagtagtgtgaatcattctgaggtgtgttccacggtgtggggtgagggttgctcgtgcgggtcgaatattaacggctacgctggccctttgtgggagatatgatatgaccagttttccttatggtgaaacggttgtgatgcttcaaccgactgttcgtgtcgatgatcttggtgacaaggttgaggattgggggcatcctgtagaaaccgtgtaccataacgtggccatctatgcttccgtttcgcaggaggatgaggccgcggggcgtgactctgactatgagcattggtcgatgcttttcaagcagtctgttgttggtgctgattatcgttgcaggtggcgtattcggggtgttgtgtgggaggctgacgggtctcctatggtgtggcatcatccgatgtctggctgggatgcgggcacgcagatcaatgtgaagcgtaagaagggctgatagattgtggctcaggatgtgaatgtgaagctgaacttgccgggtattcgtgaggtgttgaagtcttctggggtgcagggcatgttggctgagcgtggcgagcgtgtcaagcgtgcagcctcggctaatgtgggcgggaacgcttacgatagggcccaataccgtaacggtttgtcgtcggaggtgcaggttcatcgtgttgaggctgtcgctcgtataggcaccacatataagggtgggaagcgtattgaggcgaagtatggcacgctggctaggtcgattggggcagcgtcgtgatcgtctacgatgaccccaggaagtgggctaaacgtgtgttggcggatgatggctggctgtctgggataccatgcacagggacagtgccggatagctttgagggtgacctgatttggttggcgttggatggtggcccgcagttgcatgtgcgtgagcaggtgtttttgcgggtgaacgtgttttcggatacgccggatcgtgctatgtcgttggcgcgtcgtgttgaggctgtgctggttgatggtgtggacggtgatccggtggtgttttgtaggcgttctacgggtcctgatttgctggttgatggtgcacgttttgatgtgtattcgctttttgagctgatatgtaggcctgtcgaatccgagtaagcgtatcgttgtttttgttgattgatttttagtttgattgttttttgggggttatgatggctgcaacacgtaaagcgtctaatgttcgctctgctgttacgggtgacgtctatattggtaaagctcatgccggtgacactattgatggtgtgaagacggttcctgacggtcttaccgctttagggtacctgtcggatgacgggtttaagattaagcctgagcgtaaaacggatgatttgaaggcttggcagaatgcggatgttgttcgcactgtggctacggagtcttctatcgagatttctttccagctgatcgagtccaagaaggaggttatcgagctgttttggcagtcgaaggttactgccggagccgattcgggctcgttcgatatttctcctggtgccaccactggcgtgcacgccctgttgatggatattattgatggcgatcaggttattcgctactatttccctgaggttgagttgatcgatcgtgacgagatcaagggcaagaatggcgaggtgtacgggtatggtgtgacgttgaaggcgtatcctgcccagattaataagaagggtgatgcggtgtcgggtcgggggtggatgacggctttaaaagctgatactcctccttctccgaagcctcagccggatccgaatccgccatctgagaactgatacacgattttaggggattgttgatagatgagtgacacaggttacacgttaaagattggtgactgtagctgggtgttggcggatgcggaggagacggctcaggctgttcctgcccgtgtttttcgccgtgcagctaagattgcccagtcgggggagtctgcggattttgcccaggttgaggtgatgttttctatgttggaggctgccgccccggctgatgctgtggaggctttggaggggcttcctatggttcgtgtggccgagattttccgtgagtggatggagtggaagcctgaaggtaagggtgcctctttgggggaatagtttggctccacggcctgattgatgattatcgtggggccatcgaatatgattggaggacccggttcggttgctcggtttatgatgttggtggcccgcagatgtgttggggtgaggctgtccggctggctggcgtgttgtgtaccgatacgtctagccagttggcggcccaccttaatggttggcagcgcccgtttgagtggtgcgagtgggctgtgctggacatgctggatcattacaggtctgctaatagtgaggggcagccggagcctgtggcgaggcctacggatgagcgtagggcccggtttacgtctggacaggtggacgatattttggcgcgggttcgtgccggtggcggggtgtctcgcgagattaatattatggggtgaatagtgtatgtctggtgagattgcttccgcatatgtgtcgttgtatacgaagatgcctggcttgaaatcggatgttggtaaacagctttctggggtgatgcctgctgagggtcagcgttcgggtagcttgtttgctaagggcatgaagttggctcttggtggtgccgcaatgatgggcgctattagtgttgctaagaagggcctcaagtctatatatgatgtgactattggtggcggtatagctcgcgctatggctattgatgaggctcaggctaaactgactggtttgggtcacacgtcgtctgacacgtcttcgattatgaattcggctattgaggctgtgactggtacgtcgtatgcgttgggtgatgcagcttcgactgcggcggcgttgtctgcttctggtgtgaagtctggcgggcagatgacggatgtgttgaagactgtcgccgatgtgtcttatatttcgggtaagtcgtttcaggatacgggcgctatttttacgtctgtgatggctcgcggtaagttgcagggcgatgacatgttgcagcttacgatggcgggtgttcctgtactgtctttgcttgccaggcagacgggtaaaacctcggctgaggtgtcgcagatggtgtcgaaggggcaaattgattttgccacgtttgcggctgcgatgaagcttggcatgggtggtgctgcgcaggcgtctgggaagacgtttgagggcgctatgaagaatgttaagggtgccctgggttatcttggtgctacggctatggcgccgtttcttaacgggttgcggcagatttttgttgcgttgaatccggttatcaagtctatcacggattctgtgaagccgatgtttgctgccgtcgatgctggtattcagcggatgatgccgtctattttggcgtggattaaccgtatgccgggcatgatcacgagaatgaatgcacagatgcgcgccaaggtggagcagttgaagggcatttttgcgagaatgcatttgcctgttcctaaggtgaatttgggtgccatgtttgctggcggcaccgcagtgtttggtattgttgctgccggtgtggggaagcttgttgcagggtttgccccgttggcggtgtcgttgaagaatttgttgccgtcgtttggtgctttgaagggtgccgctggcgggcttggtggcgtgtttcgcgctctggggggccctgtcggtattgtgatcgggctgtttgctgccatgtttgctacgaacgcccagttccgtgccgcggtgatgcagcttgtggctgtggtgggccaggccttggggcagatcatggccgctattcagccactgtttggtttagttgctgggctggtggcccagttggctcccgtttttggccagattatcggtttggtggctggtttggcggctcagcttgtgcctgtgattggtatgctggttgcccggctggttcctgtgatcacgcagattattggcatggtgacacaggttgctgccatgttgctgcctacgttgatgccggtgttgcaggctgttgttgctgtgatacggcaggttgttggcgtgatcatgcagttggtgcctgttttgatgcctgtgattcagcagattttgggtgctgtcatgtctgtgctgccgcctatcatcggccttatccggtcgctgataccggtgatcatgtcgattatgcgtgtggtggtgcaggttgttggtgccgtgctacaggtggtggcccgtattattccggttgttatgccgatttatgtttcggtgattggattcattgccaagatttatgctgcggttatcgtttttgaggctaaggttattggcgctattcttcgtgctattacgtggattgtgaatcattcagtgtctggcgtgaggtctatgggcacggccatccagaatggctggaatcatatcaaatcgtttacgtcggcgtttattaacggtttcaagtcgatcatttctgccggtgttgccgcggttgtggggttttttacgcggcttggtttgtcggttgcctcccatgtgaggtctggttttaacgcggctcgtggcgctgtttcttctgcgatgaatgctattcggagtgttgtgtcttcggtggcgtctgctgttggcgggtttttcggttcgatggcgtcgagggttcgtagtggtgctgtgcgcgggtttaatggtgcccggagtgcggcttcttctgctatgcatgctatgggttcggctgtgtctagcggggtgcatggtgtgctgggttttttccggaatttgcctggcaatattcggcatgctctcggtaacatggggtccctgttggtgtctgctggccgtgatgtggtgtctggtttgggtaatggtatccggaatgctatgagtggcttgttggatactgtgcgtaatatgggttctcaggttgcgaatgcggcgaagtcggtgttgggtattcattccccgtctagggtgtttcgtgatcaggttggccgtcaggttgttgctggtttggctgagggtattactggtaatgctggtttggcgttggatgcgatatcgggtgtggctggtcggctgcctgatgcggttgatgcccggtttggtgtgcgttcgtctgtgggctcgtttaccccgtatggcaggtatcagcgtgcgagcgagaagagtgttgtggtgaatgtgaacggacctacgtatggggatccgaacgagtttgcgaagcggattgagcggcagcagcgtgacgctttgaacgcgttggcttacatgtgatatggggtgttgtgcatgtttattcctgacccgtctgatcgtgccggtttgactgttacctggtctatgttgccgttgattggtaatgatccggagcgtgtgcttcatttgacggattatacggggtcgtcttcggtcatgttgttgaatgattcgttgcgcggcctgggtgttcccgaggtggagcatttttctcaaactcatgttggggtgcacggctcggagtggtgcgggtttaatgtgaagcctcgcgaggtgacgctgccggtgttggtgtcgggtgttgacccggatccggatggcgggtttcgtgacggtttcatgaaggcgtatgacgagttgtggtctgcttttcctcctggcgaggagggggagttgtctgtgaagactcctgccggcagggagcgtgtgttaaaatgccggtttgattcggctgatgacacgtttacggttgatccggtgaatcgtggctatgcgcgttatgtgcttcatttgacagcttatgacccgttttggtatggggatgagcaaaagtttcgtttcagtaacgcgaagttgcaggattggttgggtggcggcccggtcggcgggaagggtacagcgtttcctgtggtgttgacgcctggtgttggttcgggctgggataatctgtataataagggtgatgtgcctgcgtggcctgtgattcgtgttgaggggcctttggagtcgtggtctgtgcagattgatggtttgcgtgtgtcttcggactatcctgtcgaggagtataattggattactattgatacggatcctcgtaaacagtctgcgttgttgaatgggtttgaggatgtgatggatcgtttgaaggagtgggagtttgcgcctatcccgcctggcggttcgaagagtgtgaatattgagatggttggtttgggtgccattgttatgtcggtgcagtacaggtttttgagggcttggtgaacggttgtggctggtcttgttccgtatgtaacgttgtttacgccggattatcgccgtgtggcgcctatcaatttttttgagtcgttgaagttgtcgttgaagtggaatggtttgtccactttggagttggtggtgtcgggtgatcattctaggcttgacgggttgactaggccgggtgcacggctggttgttgattatggtggtggccagattttttctgggcctgtgcgtcgggttcatggtgtgggtccgtggcggtcttcgcgggtgactatcacgtgtgaggatgatattcgcctgttgtggcgtatgttgatgtggcctgtgaattatcgccccggtatggttggtatggagtggcgtgccgacagggattatgcccactattcgggtgcggcggagtcggttgctaagcaggtgttgggggataatgcttggcgttttccgcctggtttgtttatgaccgatgatgagagtcgtggccgctatattaaggattttcaggtgcggtttcacgtgtttgccgataagttgttgccggtgttgtcgtgggctcggatgactgtttcggtgaaccagtttgagaatgtgaagcaggatcagcgtggtttgctgtttgattgtgtgcctgctgtgacgcgtgaccatgtgttgactgccgagtctgggtctattgtgtcgtgggagtatgtgcgtgacgccccgaaggctacgtcggtggttgtgggtggccgcggcgagggcaaggatcggctgttttgtgaggatgttgattcgatggctgagggtgactggtttgatcgtgtcgaggtgtttaaggatgcccgtaacacggattctgagcatgtgcatctcattgatgaggcggagcgggtgttgtccgagtcgggggccacgtcggggtttaagatcgagttggctgagtcggatgtgttgcggtttgggccaggcaatctgatgccgggtgatttgatctatgtggatgtgggctcggggcctattgcggagattgtgcggcagattgatgtggagtgtgtatcgcctggtgacggttggacgaaggtgactcctattgcgggggattatgaggataatccgtcggccctgttggctcgccgtgtggctggtttggctgcgggtgtgcgggatttgcaaaagttttagtaagtgattggggtttgttgtgggtattgtgtgcaagggttttgatggtgtgttgaccgagtatgattgggctcaaatgtctggtctgatgggtaatatgccgtctgtgaaagggccggacgattttcgtgtcggcactactgttcagggtgccacagtgttgtgtgaggtactgccggggcaggcgtgggctcacggggtgatgtgcacgtcgaatagtgttgagacggtgacggggcagctgcctggtccgggtgagacccgatacgactatgttgttctgtctcgggattgggagcagaacacagccaagttggagattgttcagggtggccgtgcggagcgtgccagggatgtgttgcgtgccgagcctggcgtgtaccatcagcagttgctggcgactttggtgttgtcgtctaacgggttgcagcagctgctggataggcgtgctgtggcggcccgtgtggcgtttggggagtctgcggcttgtgatcctaccccggtggagggtgaccgggtgatggttccttctggggctgtgtgggctaaccatgccggcgagtggatgctactgtcccccaggatcgaaactggttctaagtcgatcatgtttggcgggtctgctgtgtatgcttacacgatcccgtttgcccgcccgtttggtagtccgccggttgtggtggcgtctatggctacggcggctgggggcacgcagcagatcgatgtgaaagcctacaatgttactaataaggattttggtttagcgtttattacgaatgatgggtctaagccttctggtgtgcctgcggttgcgaattggattgctgtcggcgtgtgaccgggctgttgcggctgatgttgtaatgttgggtggctgtggtgtcgtggattactcctgcactggtggcttctatctgtacggcgttggccacggttttgggttctgttccggcggtcacgtctaaatctcggaggcgtttgcggcggctgtcggctcaggtggatgctttggaggagtatacgtggggtgtgcggcgtgaggttcgccggtttaacgccgggcttcctgatgatgtggagccgatgcatctccctgatgtgcctgagtttttgaaagatactgttgatggtggaggtgagcagggttgagggagttggaggaggagaagcggcagcgccgcaatttcgagaaggcttcactgatactgttgttcctgtcgcttgtgctgttggcggtggttgccgggggtgctttacggtacgggtttgtggcttcgcaaagggattcggagcaggcgagggcccagtctaatggtacagccgctaaagggttggccaaccgtgtgaagcgggtgtgtgcttcgggtgggcaggagtcggtgcggcttcaccagtctggcttgtgtgtggatgctcagcgtgttgagcggagtgtgcagggtgtgccgggtcctgccggtgagcgcggcccgcaaggccctgcaggtgctgacggccgggatggtgttaatggttcagctgggctggttggccctgttggtccgcagggttccccgggtttgaatggtgtgaaaggtcctgacgggctgcctggcgctaacggttcggatggccatgatggtgttgccggtgtgaacggcgttgatggccgggatggcgctgatggggctgatggtggccgtggccctgccggccctcaaggtgcacagggtgagcgtggccctgtggggcctcagggtccgcagggttctgccggtgccgatggcacgaatggtcgggacggcaaggatggcaaggatggccgttctgttgtgtctgtgtactgttccggggatcgcctggttgtgaaatatagtgacggtgcggtctctaccatatcgggttctgtggcctgtgagggtgtgaaaccgtcgcctatagtgactatatcatcccacaaatagaaaggagtggctgtgatggtagtgtttgggggtggcgtgttgtgagatacattccagcggcgcatcactctgccggatcaaataagccggtgaacagggttgtgattcacgcgacatgcccggatgtggggtttccgtccgcgtcccgtaaggggcgggcggtgtccacggcaaactatttcgcgtccccatcggcgggcggttctgcccattatgtgtgtgatgttggggagacggtgcagtgcctgtccgagtctacgattggttggcatgccccgccgaatccgcatagtttgggtatagagatttgcgcggatgggggttcgcacgcctcgttccgggtgccagggcatgcttacactcgtgagcagtggctggatccgcgggtgtggcccgctgtggagcgtgccgctatcctgtgtcggcagttgtgtgacaagcatggtgttccgaagaggaaactgtctgtggccgatctaaaagcgggtaggcggggcatctgcgggcacactgatgtgacggatgcgtggcaccagtcggatcatgacgatccgggaccgtggtttccgtgggacaggtttatggctgtggtgaatggccacggcggcggttcaagtagtgaggagttaacggtggctgatgtgaaagcgttacataatcagattaaacaattgtctgctcagcttagtggttcggtgaataagctgcatcacgatgttggtgtggttcaggtgcagaatggtgacctggcgcgccgtgtggaggccttgtcgtgggtgaagaatccggtgacggggaagctgtggcgcactaaggatgccctgtggagtgtctggtattacgtgttggagtgtcgcagccgcatcagtaggctcgagtctgctgtcaacgatttaaaaaagtgatggtgatgtgtgatgggtaaacagttttggttaggtttactggagcgggcggctaagacttttgtgcaaacgtttgttgctgtgttgggggtgacggcgggtgtcacgtatactgcggagtcgtttcgtggtttgccgtgggagtctgccctgatcacagctacggttgctgcggtgttgtcggttgctacatcgtttggtagcccgtcgtttgtggccggcaaacctaaaaccacgcctgtggatgcttggcttgttccacccgacgatgggggcatggtcgagcctcacatggttgatgtgtcggatcctggcatgattgagccgatggatgatgcggatgttgtcggctatgagcctcggcgtgcagccgaggctgaggttggcacggtagagtctactgttgcataattgaatatgtgtgtgccccagcggtgctgccacgatcgtgtggtggttgccgctggggcactatttttgtgtctatagtattctatgattcgttgttgttgatggtttcttcgatcagctggtccaggcggtggcaggcggagatcgtttcgttggcctggtgcggaacatcctggccgataacatttttgtggttgtcgcggtggcagatgattgactgcatgatatcgtcggcctccgcttgcagtagttttgcctggtatgcgatcccggcgagccaatctatggcttcctggcttgcctgtgtgtcgtatggaatgccacgggtgttgctgttgtttgggtatcctgcactgtcgcagtcccacaggatttcgctgcactcgtctagcgtgtcctggtcgatagcaaggttgtcgaggctgacttctttgacggtaaggttcacgttgtcgagtgagatgggtacacggtactggttttctacactgtcaacaatgttttgcagctggttcatgttggtgggctgttgttggatgattcggtgtaccgctgttttgagggcagtgtaggtgatattggttgtgttgttcatggttttatttcgtccctgtgctgtcgtcgctatcgtctggatagtatctactgtttgcgtagcctgttagggtgatgagtgtttggtctgcccactgtttcacggtttgccgggtgactccgagtcgttgggctgccacagagtaggtttggtcatacccgtagacttcccggaatgctgccagcctagctaaatgttttcgctgtttggatggctggcaggtgagggtgtagtcgtcgatggctagctgcaaatcgatcatggtaacgatgttgttgccgtggtgttgtggcgcggttggtgggggcggcattcctggttcgactgatggtttccatgggcctccgttccagatccattgggcggcttggatgatgtcggcggtggtgtaggttcggttcactggtcatcccctgaataggttgtcgaggttgtctgggttgctggtgttggtggtgtcgaatcgtcccacacagtggcagtagtcgtacatgagtttgataatgtgttggtggtctcccaaataggtgtttccgctgatgctgtaggtggctgtgccgtctttactgatggtgtatttggcggtgatggtttcgggtgtttctgtgttggtgatgatggctgtggtggtggtgcctacggtttgtagcctggtggtttgggtgccgtcgtcgaggatggttgtgaccatggtgtgtgttctcccctttcagatgctggtttggttgtcggctagatgaatgatatcggttaaaggtttcggttggtcgaggtgttgtatggttttgttggctagccgtttggctaccctgtagcacattttggtgtagtgtttgttgtctaggttgtggtattgttcccgcaccgcaatgtatagcaaagagtcttggtacaggtcgtctgcactgattgcggggtagtgtccggctgttttggtgcatgcccggttgagtgtgcgtagatgatggtctgtggcccatccccacgatgcggtggtggctaggtctgctttggttggtcgtctgctcatgtcatctctttcatctggctatctggtagttgtttggtgttttgttgttgatagtgtagcacacgagtccggggtttccggtggtgcctgtcttgtgccggtaccatgtggattcgccttccatggatgggcattggatgaaggtgcgttgtccttgctcggagatttcgaggtggtgccggtgcccggccatgagaatattagatacggtgccgttgtggaattcttggccgcgccaccaatcatagtgtttgccggtgcgccattggtggccgtgggcgtgcaggatttgtgtgcctgccacgtcgacggtggtggtcatttcgtctcggctggggaagtggaagtgtaggttggggtattggttgttgagctggtaggcttctgcgatggcgcggcagcagtccacgtcgaaggagtcgtcgtaggtggtgactccttttccgaagcgtacggcttctccgtggttgccggggatggatgtgatggtgacgttggcacagtggtcgaattggtggatgagttgcatcatggccatgcgggtgagcctgatttgttccgtcaagggtgtttgtgtgcgccaggcgttgttgcctccttgtgacacgtatccttcgatcatgtcgccgaggaaggcgatgtggacccgttgcggtttgcctgcttgctgccagtagtgttttgcgactatgagggagtgcaaatagtcgtcggcgaagtgtgctgtttctcctccggggatgcctttgccgatttggaagtctcctgccccgatgacgaaggccgcagtgctgtagtcggtgtgggtgtcttgttcgggttttgggggtgtccattcggctagtttgttgacgagttcgtcgaccgggtaggggttggttgcgggttggtggtcgatgattttttgtatggatcggccggtttctccgttcggtaaggtccattcggagatgcgtgtgcggcgtacggtgccgttggcgagattgtcgtcgatggtgtcgatggcgttgtcgtggttggctagctgtgtgagtagccggtctatattgtctatcactggttttcctcttctgtttgtggggtggtgttggcttgtttgcggcgatagtctttgatgacggtggcggagatggggtatccggcttcagtgagcatttgggctagctgtgtggcggggatggacctgtcggcgagtacgtcggcagccttatcaccgtagcgttggatgagggtttcagttttggttgccatgatgtcctaggggttgtgtggtgggttgccatcctgtgcggcagtcgccgtcgtgtcctggtttgcgggtgcaccatgatacgttgctggcattgtggatgatggcgcggccgcatatgacgtcttgtaggtgttcgggaaacttgccgttgttgtccctgtttgtgtcggtcacgtgtggggttgtggtgaccatcatgtctcctctgcgtgaaagagtgtgcaaatatgatgcgggtgtggtgggtgtttatgcgggtatggttttcatcaccttgctgaatgttacttggttattgtacatcatttgggtgatttcctggtcggttttgtcggggtgttgttttcgcaggtttgcccattggcaggcgttgtcggtttcctgctgtaaacgtgtcaggtgttgttcgttgatgatgtgtttccacatggtccatgacacgtcgagccggttaaggatttcgagggctggcacgttgaactggtcgaggaagagtatttcctccgtgtagtagtctttttcgtattggtcccatccgcttcggtgcctgttgggctggtttttggggtaggcttcccggcagattttgtgtaaccgttttgccatgtcgtcgggtagtttaatgtcggggttggcgcggatcatggatcgcatcccgtcgtaggtggtgccccaggtgtgcatgatgtggagtgggtccacgccgtcggcccatttttctgcacagatggcgaggcgtgtgcgtctcctagtggccttactcgtgtcgcggcggccggggatggggcatgtgtcgaggggatccatgatgttttctatgcctttcttggagtgatgttttgtttgtctggttttattgtagcacagtgtctagtgcttgtgtcaaccctgtttttccggcctgcagataggtgtctgtgacatccccgacagtgaggggtacgtgtatggcttgggggagtgccgtctggagggtttgggccatctggtctcctgctttgtcggggtcggaccagatgtagattcggtcgtagccttcaaaaaatttggtccagaaagtttgccacgaggtggccccgggtagggctacggccgaccatccgcattgttcgaggatcatggagtcgaattcgccttcgcaaatgtgcatttcggctgccgggttggccatggcggccatgttgtagatggagcctgtgtcccctgccggggttagatatttggggtggttgtgggttttgcaatcatgctggagtgagcagcggaaacgcatttttcgtatttcggctggctccccccagacggggtacatgtatgggatggtgatgcactggttgtagtcttcgtggcctgggatggggtcattgtcgatgtatccaaggtggtggagccgggctgtttcttcgctgatgcctcttgccgagagcaggtcgagtatgttttcgaggtgggtttcgtagagggctgaggctttctggattcggcggcgttccgcaatgttgtagggttgtagtgagtcgtacattagggttttctttctctagtcgttgtttcagtttggcgaggcctcctccgataccgcatgtgtggcagtaccagacgcccttgtcgaggttgatgctcatggagggctggtggtcgtcgtggaacgggcagaggatgtgttgctcgttcctggaaggattgtagcgtatctggtaggtgtcgaggaggcggcaggtgtcagaggtgtgggaggagctcgttgagggttgataccacataggcttcgctccagggtttgttgcgctgtttcatgatgacgagtccgatggtggactggttttcgcggttgcggtgggtttcgtagttgcgtgcctcccggctggcttgtttcacgaattcggcgaggtggggctgtccggctttggcttctattacataggttttgtggccggttgtgaggatgaggtcgccttcgtcttcccttccgttgaggtggaggcgctctatatcatggccggtgtcgcgtagctggtggaggagtcgtgtttcccattctgcgccggcccggcggttgcgtgactgttgtgtcgacatgatagtcctttgtgtgttggggtcatgttccatggctgtttttcggcgagtggcccgaagaatgtgtattcggggtaggctcgcagtcgttcgtatcgggtgccgtctgggctggatttgcctgtgcgctgttttaacacggcgatgcgtgcctctgccggtatcgataggccgttgccgttatcctcgccaccatacagggagactcccaatatgagttgtggtttttcggagaggccgtttttgatttcccgcctagccggggggtgttctatgtcggagccggttttgtcggttgcgtggtgtgtgacaataatggtggagccagtatccctgcctaatgatgtgatccattgcatggcttcttgctgggcctgatagtcactctcgcagtcttgaatgtccatcagattgtcgataacaatgagtggtgggaaggtgttccacatttccatgtaggcttgcagttccatggtgatgtctgtccatgtgatgggtgactggaatgagaatgtgatgtgttggccgtggtggatgctgtctcgatagtattctggcccgtagtcgtcgatgttttgttgtatctgggcggtggtgtgttgggtgttgagtgagatgattcgtgtggaggcctcccagggtgtcatgtcccctgatatgtagagggcgggctggttaagcattgctgtgatgaacatggctagcccggatttttggctgccggaccgccccgcgatcatgaccaaatcccctttgtgaatgtgcatgtccagattgtcatacaagggtgctagttggggtatgcggggcagttcggcggctgtttgggaggctctctcgaaggatcgttgtagagagagcatcggagcctttatctatctgtctatcggttggatgatgttttggtggtcagatggagtcgatatcgatgtcagcatcagcaggggctgtggtgtcgtctagctggccgttatcgcgtttgtctacgtattcggcaaccttatcgtagatggcgtcatcgaggggtttaagcacgaccgcgttgaacccgtttttggtgcgcacggtggcgagtttgaaggcctgctcctcgccaaggtatgcctctaggtcgcggatcatggagtgtgggcggtcgttgttgccgcgtgctttctcaataatagcgttggggatggtttctggggtgccgttgttgagatcgtctagggtgtggaagattgtgacatcagcgtaaatacgatcggcggtctgtccaccgtagccttcggtgttgtgttccacgtctcggactttgaaggcgatggcggtggcgtcctggtttcgggacgggttgaagaaggtgctgttgctgttgttgttgcggtagttggcgagtcccattgttgtttcctttactgtttgtgttgttttgtttgttggtttgtgtcggttttatcgggtgaggctgtttcgtttgttgcggaaagcctcggatacgtcactgttgctggtgatggtctttttgtattgtttgagaaggtcggctagctgtgccttgcttgtggctttgttgattttgtcgatgatggtgttgtttccttctgaggcgatgttgtctacgtagtctttggcggcctggttgtatcggtcttggaggatgatggatgctgtggcgatcagtgttgccaggtcccagttccttgccgcggagctgtttttgagtccgcctagcaggtcgatgatagtcttcttgacttggtcggcggtgtctccgcggatgacggtccatggggcggcgtagtcgcctccgtatttgagtgtgacggtgaatcggtcgtcgtctgtgttgtcggtcactggtgctccttgctttcttgtgttggggctgtgatggtggtttctatagggtacctgtaggcgtctttcccgttgacagcccagcaggcgtccttgacggggcagcctttgcagagtgctgtgacgtggggtacgaagatgccttggctgattcctttcattgcttgactgtacatggatgatacatgccggtaggtgttgttgtcaaggtcatagagttcggtggatgtgccttgtgtcggggacttgtcgtcgttgcggctggtggctggcgtccaaaacatgccttttgtcacatcgttgccgtgttggttgagcatgtacctgtaggtgtgcagctgcatactgtcggcgggtaggcgtccggttttgaggtcgagaatgaaggtttcgccagtatcggtgtcggtgaaaacgcggtcgatgtagccaacgatctgggtgccgtcctggagggtggtttctaccgggtattcgatgcctggctggccgtcaataacagcgatagcatattctggatggttgcgcctccagtttttccacctgtccacaaaggtggggccgtatatcatccaccaattgtagtcttttttgtgtggcccgcccgactcgcacatgtttttgcacaccctgccggagggtttgatttctgtgccttcggattcggcgagggcgacttgggtgtcgaaaatgtttttgaaggatgagagtttgtctggtagtgcagggtattcggtggggttgtacaggtgtaggtcgtattgttcggtgatgtggtgtatggcgcttccggcgatggtggcgtaccaggtgtggtgttgggcgtggtagccgtgggataggcgccatttttctccgcattcggcccactgtgacagtgatgagtaggagatgtggcctggatggtcgatggtggatggtttttgtgctagggacattacttgtcgcctttgtgggtgttccatgggttgcgggtgtcttggccggcgtggtgttgctggtatgcgaggagtgcgaggcagtgccaggcagcatgggctagatggggtagcccggattcatcatcgaggttgttgccttgctgccatgatagtaggtgcctgtagagggcgtcgacgctgtggctccacgggtagccgccggtccagttgttgtcgccgtatttggtggcgccgtatcctgccacggagcctagatcgtgcaaggctgcggggtcgatgagggatagcctgcagagtttcaattcttttcgggcaccggtgttggggtcggtgtacatgcgggtgggctcatccatggggtgtgtgctccttgagtgtgggttactggttggggttgtgggcgagtgctacggcgagaataatgatggcgagggtttcagcaataagtatgggtgttgtgatcatttagtgtctcggggattgttggtgagggttgaggcgcctaggagggtggtgagggcgcatgcggcgatgatggcgagggctgccttgtgtggggtgccggttgcgtacatccatgtgatgatggcgccttggatccaggcgaggctggtgaagaacgtttcgtagctgtgtagctcaatgttgttgggtgtgttcatgcttgctcctgaagaatggtgttgatggttttataaatgttgtacaggtcggtttcgatagataacagttggtggatttcgtggtcgagatcaatgtctgggttgagggtgttgatgcgggaggcaatatcggtggctgtgcgtagtgtgccgccggtgtggtgaataatgtgtgccgtgtcggcgagtccggtggtgacagcgtagtgggagaggagaggcatagctggggggtgctccttggcgggttactgttgcgggttgatgttgaggtcggtgacgtgcgggtggtcttctgttccggtgacgaggcagtggacggtgacgggtagtttggatgctcccggctggcggacggtggcgccgtagacgatggagaaggtgtctttgccaataattttgtggagttggaggtcgatgtcggggttgccgttccagttgacaccgtgtgcggcggcctgttgttcggctttgcggttgcaggtgtgtgcggccgtgatcatggtgagaccttgtgaggtttcttcaccccttgtttgggcttgccggtgggctttccgctgttcggctcgcagtgactgttctgcggctgcctgccgtgctttcttgtcggctttgcgctgttggacggttttgggggtccattcggtgttggctgtggtggcctgtggggcgggttgtgaggtgagtggcggattgtcgtctggggctggcatgaatgaggcggcggcaatgatggcggctgtgattccggcgatggtgtagcctgttttcttgttcatgattgttgtcccctttccggggtgttgttcgttgctgacatgatcaatacttccagtgactggacctcgtgtcaaggctgcgctcaacgattgtgagcgatcattgtatggctaggggttttatcggctgtacagggtgagtaggtggccaacattgatacgggtcacgttccagtagagttgtgtggcttctccaccggtgagcggcttccactcgtcgtggctgaacacggtgccatcggatgcgatgaatgtgttggggcgtagcttgtggagttcggcttccacgctctgccggtaggcttcggcgaggctctcaaaatccatgtggtcgcaggagaggttttcgaggcgtgtcaggtcgaagggtgtggggcagtcgtagctggcggggctgtagagctgggtgaagtggttggcgatcttctgcatcatgattccttttctggtgatggtgtgttgatggttttatcgtgtggcttcggcgatgatagcgtcgaggtcgatcatgtcgatcatgtcgtggagttcctcagcctcattctcagataggtggcgccagtcacagtctccgtatacggcgccgtcgagggtgacagtccacagtggccggatgagtcgtatggcttcttgtactttagcgtggtacatgcggcgcaccatatcgagatcgatgtcgtctgaatggtttccggtgaggctgtggaggctgagcgggtcgatctcggtctgcccgtagagggaggtgatggatggggtaatgagtgtggtggccatttttggtgtgttcctttcggtggtgtatgggttgttgtggtttctagagtgtgcgggctgcgaccccacagtcaaggctgcgctcattcggattgagcgtttcatatgagtgtggcatgggatgtggtgtatctcacttaagcttttattgcctctctcagcgtctcaaatcttctggaggtaggagattatagggttggccctgctgatcgattctaggccccatacagggcgtctcaggggcatgtatgggtgatagcgggtgtggcagatgatctagcgagtcgagatagtcctgcattgtaaaggtcgaggtgtcagatctgggcatggaatccacacccccatactatgtgagatgtatcacatcctcctgacttggtgtgcaccctcgaggccatcctgtcgatctggcgtgaagggtgtagcccagaaatgccgtttaaagccttcacactgcgcctaggagcgccttgcagggtgggggctaggtgtttatacccccaagcaattctgatcgattctagacgcctcccagagcctgatacgcgatccgctatccagacacagaccatcagcccctatcctggttagctaagcctcaactatgtggacagtgtgggatgctaagagggaagaaggacacggtacaagaaagagggggagcatcagccttcaagccttaaggtcttagcgcttggcaccgagcccctcaagggcttggcatcagcccgacagcccgagcaggctcagccgaacaggcacagcaatgaaaagggtacacgccatcagggaaggtttgagagtacgaggagccctagcgacgagtactctcaaacctgagggaacaccctcagcactgatgggcctagcgtgttcggaaaggacacgggtcaaggtgtgacagctgtccgggagtgaaacccgttctgactaggggtttcagccttaaccaccctcaaaggttacaagaatctaagaaaatttaaggaaaagtttaggtttaatttttggacctttactaccaaaaacacccgtttacacccctcaaacccgcctatagagccaaaaccaccagtttgactcatcccaggtggggtatgataggctggacaggtagccagctggacgcaaggccgaaatccgctgacgcggctttcacccttacatccatcagtctaccaaacacttaaagacataagggcttagcgctaaggtgctgatagcttagcaccgagcccctcaagggctcggcatcagtcttaaagccttcaacacttaaagtacatataaaactttaaaagttaaacgttaaaagctttaaaccttaacacctaagttaagtataaaaccttaaaagcttagcacttaaggatataaactttacatcagtgtttaagacttaaaaccttaaagctttaaacacttaaagtaactataaaacattaaagaccttaagtacttaaagttaaccatcagtcttaaactttattattataacctataagtcttaaagcttataggtattataatataatataagttataaaagttttagaagagctaaggggttaacttctttacttctcttctctctttggtactttctctcttctcttcttttcttcatcaggggagaagaggaacctttaccatcagcgccgatgggctttcaccgtgtgactcgtgtaccaccggtcgcacgctcccggttgcacactccccacacttactctacccgtgtccctttcaggcttggcgtgttcggctgaaggcgtacggcgtgtcacgctctcatccttaacaccgggtgagacttaaagtgtatattatatgtagaagactttaaaacctatcaggtgttcccgcttagcccgtgtcctacatcgccaagcgctaagccttgaaacgcgaacacacacccacccccatttttcttccgtatccttctcttttaacacagctggggggcgatgtgatctttctcacacccaggggggtggtggagaaaacaaacaccccggcacaaacagaacaccccctcaaacgaacaaaacagggcctagaatcgatcagcagggcatcggtagggtattcatacccccaacggttcccaggccgttacaggggcaatgagaggctcacgggggcaaggggagatcaggggacgtgatggcacataccaaccgcaccgcatcctccgcccatcgacgctggcggcaacgactcatcacccaagcacgacagcaaggccaaaccacctgcccactctgcggagtcaccatcacctggggcacacacgacctaccaaccagccccgaagccgaccacatcacacccgtcagccggggaggactcaacaccctcgacaacgggcaaatcatctgcagaacatgcaacagaagcaaaggcaacagaacacaaccaaacatcacattccaacaacaaaccacaaaaacattgattccatggtgacaaacccgccaacccccaccggggacaccccctgcacaggcgtgcaagacc

SEQ ID NO: 34 - DNA, 29514 bp, Unknown
  source: /note="Description of Unknown: Bacteriophage of P. acnes"
agtgaaatacctcccttttgtggatttgtctgtttgtcgactttttgtgttggtggtgagtgttgtgcagcctgagcttcctgggtctcgtgaatggtgtgaggagacgcgtcgttggtggcgtgtgtggggtgaggatagccgcgcatcgtacgtgtcggatgaggagtggctgtttcttatggatgctgcggtgattcatgattgtgtgtggcgtgagggtcgcgcggatttggtggcttcgcttcgtgctcatgtgaaggcgtttatgggcatgttggatcggtattcggttgatgtggcgtctggtggccgtggtgggggttctgcggtggcgatgattgaccggtataggaagcgtaggggtgcttgatgtctcaggttgtgggttctcaggttcctcgtaaccgtgtggctgcggcgtattcggtgtctgctggcggtgatgctggggagcttggtagggcttacgggttgacgcctgatccttggcagcagcaggtgttggatgattggctggctgtcggtggtaatggcaggcttgcttcgggtgtgtgtggggtgtttgtgcctcgccagaatgggaagaacgcgatccttgaggttgtggagttgtttaaggcgactattcagggtcgccgtattttgcatacggctcacgagttgaagtcggctcgtaaggcttttatgcggcttcgatcgttttttgagaatgagcggcagtttcctgacttgtatcgtatggtgaagtcgattcgggcgacgaatggccaggaggctattgtgttgcatcatccggattgtccgacttttgagaagaagtgtggctgcagcggttggggttcggttgagtttgtggctcgtagccggggttctgctcgcgggtttacggttgatgatttggtgtgtgatgaggctcaggagttgtcggatgagcagttggaggctttgcttcctacggtaagcgctgccccgtctggtgatccgcagcagattttccttggtaccccgcctgggccgctagcggacggtagcgtggtgttgcgtcttcgcgggcaggctttgtcgggtggtaaaaggtttgcgtggacggagttttcgattcctgacgagtctgatccggatgatgtgtcgcggcagtggcggaagcttgcgggggatactaatccagccttgggtaggcgtctgaattttgggaccgtgagcgatgagcatgagtcgatgtcggcggcaggttttgctcgggagcggcttggctggtgggatcgtggccagtctgctacgtcggtgataccggccgataagtgggcgcaatccgctgtggatgaggtttctttgtctggcgggaaggtttttggtgtctcgttttctcgttctggggatcgtgtcgcgctagctggcgccggcaagactgatgctggggttcatgttgaggtgattgatgggctgtctggcacgattgttgatggtgtgggccggttggctgattggttggcgttgcgttggggtgacactgaaaagattatggttgccgggtctggtgcggtgttgttgcagaaggctttaagtgatcgtggtgttccgggccgtggcgtgattgtggctgatactggggtgtatgtggaggcgtgtcaagcgtttcttgagggtgtcaggtctgggagtgtttctcatcctcgtgccgattcgaggcgtgacatgttggatattgctgtgaggtcggctgtgcagaagaagaaaggttctgcgtggggttggggttcctcgtttaaggatggttctgaggttcctttggaggctgtgtctttggcgtatcttggtgcgaagatggcgaaagctaggcggcgtgaacggtctggtaggaagcgggtgtctgtggtatgaactcggatgagttggctctgattgagggcatgtacgatcgtatccaaaggttgtcttcgtggcattgccgcattgagggctactatgagggctctgcccgggtgcgtgaccttggtgtggctattccgccggagttgcagcgggtgcagacggtggtgtcgtggcctggtatagctgtggatgctttggaggagcgtctggattggcttggctggacgaatggtgacggctacggtctggatggtgtgtatgctgcgaatcggcttgctacggcttcgtgtgacgtgcatttggatgcgctgatttttgggttgtcgtttgtggctgttattccccagggggatgggtcggtgttggttcgtccacagtcaccaaagaattgcactggccggttttcggctgacgggtctcgtttggatgcgggtttggtggttcagcagacgtgtgatcctgaggtggttgaggctgagcttttgcttcctgatgtgattgttcaggtggagcggcggggttcgcgtgaatgggttgaggtggatcgtataccgaatgtgttgggtgctgttccgcttgtgcctattgtgaatcgtcgccgtacttctaggattgatggccgttcggagattactcggtcgattcgtgcttacacggatgaagcggttaggactttgcttgggcagtctgtgaatcgtgacttctacgcctatccgcaaaggtgggtgactggcgtgagcgcggatgagttttcgcagcctggctgggtgttgtcgatggcttctgtgtgggctgtggataaggatgatgacggtgataccccgaatgtggggtcgtttcctgtcaattcgcctacaccgtattcggatcagatgcgtttgttggcgcagttgacggcgggtgaggctgcggttccggagcgctatttcgggtttatcacgtctaacccgcctagtggggaggctttggctgcggaggagtctcggcttgtgaagcgtgctgagcgcaggcagacgtcgtttggtcagggttggttgtcggttggtttcctggctgccaaggcgttggattctcgtgttgatgaggccgcgtttttcggtgatgtgggtttgcgttggcgtgatgcttcgacgccgactcgggcggctacggctgatgctgtgacgaagcttgttggtgccggtattttgcctgctgattctcggacggtgttggagatgttgggtttggatgatgtgcaggttgaggctgtgatgcgtcatcgtgctgagtcttcggatccgttggcggcgctggctggggctatttctcgtcaaactaacgaggtttgataggcgatggcttcgggtgctatgtcgaggcttgctgcgactgagtatcagcgtgaggcggtcaggtttgctgggaagtatgcgggctattatgccgagcttggtcgtttgtggcgtgccggcaggatgagtgacacgcagtatgtgcgtttgtgtgtggagttggagcgtgccggccatgacggttcagcagctatggcagctaaattcgtgcaagattttcgccggttgaacggtgtcgatcctggtttgatcgtgtatgacgagtttgatgctgctgcggctttggctaggtcgttttcgactatgaaggttatgaatagtgacccggatagggcgaatgatactattgatgctatggcggcgggtgttaatcgggctgtcatgaatgctggccgtgacacggttgagtggtctgctggtgcgcagggtaggtcgtggcgtcgggtgactgatggtgatccgtgtgctttttgtgccatgttggctacgaggtcggattatacgactaaggaaagggcgcttactactggtcatactcggcgtcataggcgtggtggtaagcgtccgcttggttcgaagtatcatgataattgtggttgtacggtggttgaggttgttgggcgttgggaaccaaatagggctgatgccgagtatcagcgggtttatgagaaggcccgtgagtgggttgatgatcatgggttgcagcagtcgcctggcaatattttgaaggctatgcgtactgttggcgacatgagatgataggttccggttgtgcaccgccggttatcggtgcacatggttgtctcccgcacgggggccaacaagttagtgttgttttccgcaaggagtgtaaggttaggctatggccgatcagaatgttgaggaacagaatgttgacaatgatgttgttgagtccgaaaaggataatggcattgttgatacagtaaaagacgatggcgggcaggatgtagccgacaatcagttgaagaatgaaggcgagggtaaatcgtcggggactgattggaaggctgaggctcgtaagtgggagtcgcgtgctaaaagtaatttcgccgagttggagaagcttcgtacatcgagtgacgattctggatctactattgatgagcttcgccgcaagaatgaggaactcgaggttaggatcaacgggtttgttcttgagggtgtgaagcgcgaggtggccgccgagtgtggcctgtcgggtgatgctgtcgctttcttgcacggtagcgatcgtgaagcactggtggagtctgctaaggctttgaagggtttgatcgaccagagtggtggtggcgcgggtgtgcgccgtcttgcggggagtgcccccgttgatgatgttaaacgacgtgagggtgtcgcgtttgtggatgctcttgtcaataattctaggagatgatttctgatggctgacgattttctttctgcagggaagcttgagcttcctggttctatgattggtgcggttcgtgaccgtgctatcgattctggtgttttggcgaagctgtcgccggagcagccgactatttttggccctgttaagggtgccgtgtttagtggtgttcctcgtgcgaagattgttggtgagggtgaggttaagccttccgcgtctgttgatgtttcggcgtttactgcgcagcctatcaaggttgtgactcagcagcgtgtctcggacgagtttatgtgggctgatgccgattaccgtctgggtgtgcttcaggatctgatttccccggctcttggtgcttcgattggtcgcgccgtggatctgattgctttccatggtgttgatcctgccactgggaagcctgctgcggctgtcaaggtgtcgctggataagacgaatcatgttgttgatgcaaccgatagcgctacgaccgatcttgttaaggctgtcggtcttatcgctggtgctggtttgcaggttcctaacggtgttgctttggatccggcgttctcgtttgctctgtcgactgaggtgtatccgaaggggtctccgcttgccggtcagccgatgtatcctgccgccggtttcgctggtttggataattggcgcggcctgaatgttggtgcttcttctactgtttctggcgccccggagatgtcgcctgcctcgggtgttaaggctattgttggtgatttctcgcgtgttcattggggtttccagcgtaacttcccgattgaactgatcgagtatggcgacccggatcagactgggcgtgaccttaagggacataacgaggttatggttcgtgccgaggctgtcctgtatgtggctatcgagtcgcttgattcgtttgctgttgtgaaggagaaggctgccccgaagcctaatccgccggccggtaactgattcatttgttgcggtgatgttttctatgtgcagggggtggtgttgatgggtatcattttgaagcctgaggatattgagcctttcgccgatattcctagagagaagcttgaggcgatgattgccgatgtggaggctgtggctgtcagtgtcgccccctgtatcgctaaaccggatttcaaatacaaggatgccgctaaggctattctgcgcagggctttgttgcgctggaatgatactggcgtgtcgggtcaggtgcagtatgagtctgcgggtcctttcgctcagactacacggtctaatactcccacgaatttgttgtggccttctgagattgctgcgttgaagaagttgtgtgagggtgatggtggggctggtaaagcgttcactatcactcccactattaatggtcgatatgtacattctgaggtgtgttccacggtgtggggtgagggttgctcgtgcggatctgatattaacggctacgctggccctttgtgggagatatgatatgaccagttttccttatggtgaaacggttgtgatgcttcaaccgactgttcgtgtcgatgatcttggtgacaaggtggaagactggtctaagcctgtcgagactgtgtaccataacgtggccatctatgcttccgtttcgcaggaggatgaggccgcggggcgtgactcggattatgagcattggtcgatgcttttcaagcagcctgttgtgggtgctgattatcgttgtcggtggcgtattcggggtgttgtgtgggaggctgacgggtctcctatggtgtggcatcatccgatgtctggctgggatgctggtacgcaggttaatgtgaagcgtaagaagggctgatagattgtggctcaggatgtgaatgtgaagctgaacttgccgggtattcgtgaggtgttgaagtcttctggggtgcagtcgatgttggctgagcgtggcgagcgtgtcaagcgtgcagcctcggcgaatgtgggcggtaatgcttttgatagggcccagtatcgtgcagggttgtcgtcggaggtgcaggttcaccgtgttgaggctgtggcccgtattggcaccacatataagggtgggaagcgtattgaggcgaagcatggcacgctggcccggtcgattggggctgcgtcgtgatcgtttacggtgatccgcgtgtgtgggctaaacgtgtgctcaaggatgatggctggctgtctgggataccgtgtacagggacggtgcctgacgatttcagcggtgacctggtctggttggcgttggatggtggcccgcagttgcatgttcgtgagcaggtgtttttgcgggtgaatgtgttttcggatactccggatagggctatgtcgttggcgcgtcgtgttgaggctgtgctggctgatggtgtggacggtgaccctgtggtgtactgtaaacggtctactggccctgatttgctggttgatggtgcacgttttgatgtgtattcgctttttgagcttatatgtaggcctgcggagtctgaataagcttattttttgttttaatgtaattgtttgatatttaatgggggttgtgatggctgcaacacgtaacgcgtctaatgttcgctctgctgttacgggtgacgtctatattggtaaagctcatgccggtgacactattgatggtgtgaagacggttcctgacggtcttaccgctttagggtatctgtcggatgacgggtttaagattaagcctgagcgtaaaacggatgatttgaaggcttggcagaatgcggatgttgttcgcactgtggctacggagtcgtctatcgagatttctttccagctgatcgaatccaagaaagaggttatcgaactgttttggcagtcgaaggttactgccggatccgattcgggttcgttcgatatttctccgggtgccacgacgggtgttcacgccctgttgatggatattgtggatggcgatcaggttattcgctactatttccctgaggttgagcttgtcgatcgtgacgagatcaagggtaagaatggcgaagtgtacgggtatggtgtgacgttgaaggcttaccctgcccagattaaccataagggtgatgcggtgtctggtcgggggtggatgacggctttaaaagctgatactcccccggttcctccttctccgaagccagagactcctaagccgcctaagcctgagccggatcctaatccgccggccggtaactgatacactattttagggattgttgatagatgagtgacacaggttacacgttgaagattggtgaccgtagctgggtgttggcggatgcggaggagacggcgcaggctgttcctgcccgcgtttttcgtcgtgccgccaggattgcccagtcgggggagtctgcggatttcgcccaggttgaggtgatgttttctatgttggaggctgccgccccagcggatgcggtggaggccctggaggggcttcctatggttcgtgtggcggaggttttccgtgagtggatggaatacaagcctgacggtaagggtgcctcgctgggggaatagtttggctccacggcctgattgatgattatcgtggggccatcgaatacgatttccgcaccaagtttggtgtttctgtttatagtgttggtggcccgcagatgtgttggggtgaggctgtccggctggctggcgtgttgtgtaccgatacgtctagccagttggcggcccacctgaatggttggcagcgcccgtttgagtggtgtgagtgggctgtgttggacatgttggatcattacaggtctgctaatagtgaggggcagccggagcctgtggcgaggcctacggatgagcgtagggcccggtttacctctgggcaggtggacgatattttggcgcgtgttcgtgccggtggcggggtgtctcgcgagattgatattatggggtgaatagtgtatgtctggtgagattgcttccgcatatgtgtcgttgtatacgaagatgcctggccttaaaagtgatgttggtaaacagttgtcgggtgtgatgcctgctgagggtcagcgttcgggtagcttgtttgctggcgggatgaagttggcgcttggtggtgcggcgatgatgggtgccatcaatgttgctaagaagggcctcaagtctatctatgatgtgactattggtggcggtatagctagggcgatggctattgatgaggctcaggctaaactgactggtttgggtcatacgtcgtctgacacgtcttcgattatgaattcggctattgaggctgtgactggtacgtcgtatgcgttgggtgatgcggcgtctacggctgcggcgttgtctgcttcgggtgtgaagtctggcgggcagatgacggatgtgttgaagactgtcgccgatgtgtcttatatttcgggtaagtcgtttcaggatacgggcgctatttttacgtcggttatggcgcgcggtaagttgcagggcgatgacatgttgcagcttacgatggcgggtgttcctgtgctgtctctgttggctaggcagactggtaaaacgtctgctgaggtgtcgcagatggtgtcgaaggggcagattgattttaacacgtttgcggctgcgatgaagcttggcatgggtggtgctgcgcaggcgtctggtaagacgtttgagggcgctatgaagaatgttaagagcgccctgggttatttgggtgctacggctatggccccgtttttgaacggcctgcggcagatttttgttgcgttgaatccggttattaagtctatcacggagtctgtgaagcctttgtttgcgtcggtggatcaggggattcagcggatgatgccgtctattttggcgtggattaaccgtatgccggctatgatcactcgaatgaatgcacagatgcgcgccaaggcggagcagttgaagggcatttttgcgaggctgcatttgcctgttcctaaggtgaatttgggtgccatgtttgctggcggcaccgcagtgttcggtattgttgctgcgggtgttgggaagcttgttgcggggtttgccccgttggctgtgtcgttgaagaatctgttgccgtcgtttggtgctttgaggggtgccgctggggggcttggcggcgtgtttcgcgccctgggtggccctgtcggtattgtgatcggcttgtttgctgccatgtttgctacgaacgcccagttccgtgccgctgtgatgcagcttgtgggggttgttggccgggctttggggcagattatggtcgccttgcagccactgttcggtattgttgctggcgtggttgccaggttggcgccagtgttcggccagattatcggtatggttgctggtttggctgcccgactggtgcctgttattggtatgcttattgcccggctggtgcctgttatcacccagattattggtatggtaacccaggttgctgcaatgttgttgcctatgctgatgccggttattcaggctgttgttgctgtgatacggcaggttattggcgtggtcatgcagttgatacctgttttgatgccggttgtgcagcagattttgggtgctgtcatgtctgttttgccgccgattgttggtttgatacggtcgctgataccggtgatcatgtcgattatgcgtgtggtggtgcaggttgttggcgccgtgctacaggtggtggcccgtattattccggttattatgccgatttatgtttcggtgattggattcattgccaagatttatgctgcggttatcgtttttgaggctaaggttattggcgctattcttcgtactattacgtggattgtgaatcattcagtgtctggcgtgaggtctatgggtacggccatccagaatggctggaatcatatcaaatcgtttacgtctgcgtttatgaacggttttaagtcgatcatttctggcggtgttgccgcggttgtggggttttttacgcggcttggtttgtcggttgcctcccatgtgaggtctggttttaacgcggctcgtggcgctgtttcggctgcgatgaacgggattcggagtgttgtgtcttcggtggcgtctgctgttggcgggtttttcagttcgatggcgtctcgtgttcggaatggtgctgtgcgcgggtttaatggtgcccggagtgcggcatcttccgctatgcatgctatggggtccgctgtgtctagtggtgtgcatggtgtgctgggttttttccggaatttgcctggcaatattaggggcgccttgggtagtatgggctccctgttggtgtctgctggccgcgatgtggtggccggtttgggtaacggtatcaagaatgctatgagtggcctgctggatacggtgcgtaatatgggttctcaggttgctaatgctgcgaagtcggtgttgggtattcattccccgtcgagggtgtttcgtgaccaggttggccggcaggttgttgccggtttggctgagggtattactggtaatgctggtttggcgttggatgcgatgtcgggtgtggctggtcggctgcctgatgcggttgatgcccggtttggtgtgagatcgtctgtgggctcgtttaccccgtatggcaggtatcagcgtgcgagcgagaagagtgttgtggtgaatgtgaatgggcctacgtatggtgatcctaacgagtttgcgaagcggattgagcggcagcagcgtgacgctttgaacgcgttggcttacgtgtgattgggggtgtggttcatgtttcttcctgacccgtctgatcgttctggtttgactgttacctggtctatgttgccgttgattggtaatgatccggagcgtgtgcttcatttgacggattatacggggtcgtctcctgtcatgttgttgaatgattcgttgcgcggtttgggtgtgcccgaggtggagcatttttctcaaactcatgttggggtgcacggctcggagtggcgcgggtttaatgtgaagcctcgcgaggtgacgctacctgtcctggtgtcgggtgttgagccggatcctgatggcgggtttcgtgacggttttttgaaagcctatgacgcgttgtggtctgcttttcctcccggggaggagggtgaactgtcggtgaagactcctgccggtgttgagcgtgtgctgcggtgtcggtttgattctgtggatgacacttttacggttgatccggtgaacaggggttatgcgcgttatctgttgcatttgacggcttatgacccgttttggtatggggatgagcaaaagtttcgtttcagtaacgcgaagttgcaggattggctgggtggcggccctgtcggcaagaagggtacagcgtttcctgtggtgttgacgcctggtgttggttctggctgggataatttgtcgaataagggtgatgtgcctgcgtggcctgtgattcgtgttgaggggcctttggagtcgtggtctgtgcagattgatggtttgcgtgtgtcttcggattggcctgtcgaggagtatgattggatcactattgatacggatcctcgtaagcagtctgctttgttgaatggttttgaggatgtgatggatcgtctgtctgagtgggagtttgcgcctatcccgcctggcggttctaagagtttgaatattgagatggttggtttgggtgccattgttgtgtcggtgcagtacaggtttttgagggcttggtgaatagttgatggctggtcttgttccgcatgtaacattgtttacgccggattatcgccgtgtggcgcctatcaatttttttgagtcgttgaagttgtcgttgaagtggaatggtttgtccactttggagttggtggtgtctggggatcattctaggcttgacgtgttgactaggccgggtgcacggctggttgttgattatggtggtggccagattttttctgggcctgtgcgtaaggttcatggtgtgggtccttggcgttcttcgcgggtgacgatcacgtgtgaggatgatattcgcctgttgtggcgtatgttgatgtggcctgtgaattatcgtcctggtatggttggtatggagtggcgtgccgacagggattatgcccactattctggtgctgcggagtcggttgctaagcaggtgttgggggataatgcttggcgttttccgcctggtttgtttatgaacgatgatgagagtcgtggccgctatattaaggattttcaggtgcggttccacttgttttccgataaactgttgccggtgttgtcgtgggctcggatgactgtcacggtgaaccagtttgagaatgcgaagtttgatcagcgtggtttggtgtttgattgtgtgccggctgtgacccggaaacatgtgttgactgccgagtctggttcgattgtgtcgtgggagtatgtgcgtgacgcccctaaggctacgtctgtggtggttggtggccgcggcgagggcaaagacaggctgttttgtgaggatgttgattcgatggccgaggatgactggtttgatcgtgtcgaggtgtttaaggatgcccgtaacacggattctgaacatgtgcatcttattgatgaggctgagcaggtgttgtccgagttgggggctacgtcggggtttaagatcgagttggcggagtcggatgtgttgcggtttgggccaggcaatctgatgcctggggatttgatctatgtggatgtaggctcgggccctatcgcggagattgttcggcagattgatgtggagtgtgattcgccgggtgatggttggacgaaggtgacacctgttgcgggggattatgaggataatccgtcggcgttgttggctcgccgtgtggctggtttggctgcgggtgtgcgggatttgcaaaaattctaattgttaggggtttgttgtgggtattgtgtgtaaagggtttgatggtgtgttgaccgagtatgattgggctcaaatgtcgggtctgatgggtaatatgccgtccgtgaaagggccggacgattttcgtgtcggcacgacgattcagggtgccacagtgttgtgtgaggtcctgccggggcaggcttgggctcatggggtgatgtgcacgtcgaatagtgttgagacggtgacagggcagctgcctggccctggtgagacccggtacgactatgttgttctgtcgcgggattgggagcagaacacagccaagttggagattgttcccggtgggcgtgcggagcgtgcccgtgacgtgttgcgtgccgagcctggcgtgtaccatcagcagctactggctactttggtgttgtcgtctaacgggttgcagcagcagcttgacaggcgtgctatagcggcccgtgtggcgtttggggagtctgctgcgtgtgacccgacccctgtggagggtgaccgggtgatggttccttcgggggctgtgtgggctaaccatgccggcgagtggatgttgttgtctccgcgtatcgaaacgggttctaagtcgatcatgtttggtggttctgctgtgtatgcttacacgattccgtttgatcgccagttcagtagtccgcctgttgtggtggcgtctatggctacggcggctgggggcacgcagcagatcgatgtgaaagcctacaatgtgactgcccaaaattttagtttggcgtttattacgaatgatggttcgaagccgaatggtgtgcctgcggtggctaattggattgctgtcggcgtgtgactgtacaggtgttgtggcggatggtgtgatattggggggctgtggtgtcgtggtttactcctgcactggtggcctctatttgtaccgcgttggccacggttttgggttctgttcaggcggtcacatcccgttctaggcggcgtttacgcaggctgtctgcgcaggtggatgctttggaggagtatgcgtggggtgtgcggcgtgaggttcgccggtttaactcgcggcttcctgacgaggtggagcctatgcgtcttcctgatgtgcccgagtttttgaaggatactgttgatggtggtggggggtgaattgtgagggagttggaggaggagaagcggcagcgccgctcgtttgagaaggcttcacttatattgttgttcttgtcgcttgtgttgttggcggtggttgctgcgggtgctttacgtttcggggctgtatcctctgagcgggattcggagcaggctaaagcccagtctaatggtacagccgctaaaggtttagccagccgtgtgaagcaggtgtgtacccagggtggcgtggagtctgcgcggcttcaccagtctggcttgtgtgtggatgctcagcgtgttgagcgtagcgtgcagggtgttcctggcccggctggtgagcgcggcgaggtgggcccttcgggtcctgccggcccgcaaggcgcacagggggagcgtggtgagcgtggccccgcaggtgtgaacggatccgacggtaaagacggtaaggatggcgctgatggccgtgatgggcgttcggtgatatcggtgtactgttccgggggccgcctggttgtgaaatatagtgacggtacggcctctaccgtgtcgggttctgtggcttgtgagagtgtgaaaccgtcacctgtggttaccgtatcatcccataggtgaacaagaagagggaagggtgttactagtgttgattgtggtgtttgggggtggtgtgtggtgagatacattccagcggcgcatcactctgccggttcgaatagtccggtgaacagggttgtgattcatgcaacatgcccggatgttgggtttccgtccgcctcccgtaagggtcgggcagtgtccacggcaaactattttgcttccccatcatcgggtggttcggcgcattatgtgtgtgatattggggagactgtgcaatgcctgtccgagtctacgattggttggcatgccccgccgaatccgcattctttgggtatagagatttgtgcggatgggggttcgcacgcctcgttccgtgtgccaggacatgcttacactcgtgagcagtggcttgatccgcaggtgtggcccgcggtggagagggcggcggtgctgtgccggcagttgtgtgacaagcatggtgttccgaaaaggaaactgtcggctgccgatttgaaggccggtaaacgtggtgtttgcgggcatgtggatgttacggatgcgtggcatcagtcggatcatgatgatccggggccgtggtttccgtgggacaaatttatggctgtggtgaatggccacggcggcggttcaagtagtgaggagttgagtatggctgatgtacaagcgttacataatcagattaaacagttgtcggcacaggtggcccagtcggtgaataagctgcatcacgatgttggtgtggttcaggtacagaatggtgatttgggtaaacgtgttgatgccctgtcgtgggtgaagaatccggtgacggggaagctgtggcgcaccaaggatgctttgtggagtgtctggtattacgtgctggagtgtcgcagccgcatagacaggctcgagtctgctgtcaacgatttgaaaaagtgatggtggtttgttgtgggtaaacagttttggttaggtgtgctggagcgggcgttaaagacttttgttcaaacgtttgtggctgtgttgggggtgacggcgggtgtcacgtatactgcggagtcgtttcgcggtttgccatgggagtctgccctgattacggccacggttgctgcggtcctgtcggtggctacctcgtttggtagcccgtcgtttgtggccggcaaacctaaaaccatggttgtggatgctgggcttgttccacccgacgatgggggcatggttgagccgcactcggtggatgtgtcggatcctggcatgatcgagcctgcagatgatgtggatcttggtgtaggctatgagcctcggcgtgcagccgagtcggaggttggcacagtagagtctactgttgcataagtgaatatagatgtgtgccccagcggtgctgccacgattgtgtggtggttgccgctggggcactatttttgtatattgcggtgtggctatgattcgttgctgtcgatggtgtcttcgagcatctgatacaggtggaggcaggtagagatcgtttcgctggcctggtcgagaacgttccggccgataacgtttttgtggttgtcgcggtggcggatgatagcccacatgatctcgtcggctgccgcctgtaatagtttggcctggtatgcgattccggcgagccagtctagtgcttcctggcttgcataggggctctggttctcgctgttgccgcgggtgttgctgttgtttgtggggtgtcctgcactgtcgcagaaccataggatttcgctgcactcgtctagcgtgtcttggtcgatagcgagatcgtcgaggctgacattgttgacggtaaggttcacgttgtcgagggagatgggtacaccgtactggttttcgacactgtcaacaatgttttgtagttgttgcatgttggtgggctgttgttggacgatgcggtgtatcgctgtgttgagggtggtgtaggtgatgttgtgtgtgttgtccatcgtgttatgccattccttcgttatcgtctggcatgtagtatgtgctgtttgcgtactcggttaacgtcatcagtgtttggtctgcccactgtttcacggtttgccgggtgacacctaatcgttgggcggctgtggcgtaggtttggtcgtatccgtagacttcccggaatgctgccagcctagctaaatgttttcgctgtttggatggttcacaggtgagtgtgtagtcgtcgatagcgagctgtagatcgatcatggtgacgatgttgttgccgtgatgctggggggcggttggtgggggtggcattcctggttcgacggatggtttccatggtccgccgttccagatccattgggcggcttggatgatgtcggcggtggtgtaggttcggctcacttggtcaccccctgaacatgttgtcgaggttgttggtgttgctggtgtcgaatcgtccgacgcagtggcagtagtcgtacatgagtttgatgatgtgttggtggtcgccgaggtaggtgtttccgctgatgctgtaggtggctgtgccgtctttgctgatggtgtatttggcggtgatggtttcgggtgtttctgtgttggtgatgatggctgtggtggtggcgcctacggtttgtagcctggtggtttgggttccgtcgtcgaggatggttgtgaccatggtgtgtgttctccttttaaatgctggtttggttgtcggctatggacgtgatttcgtgtaccggtttgggtaggtctaggtgttgtatggttttgttggctagccgtttggctaccctgtaacacattttggtgtagtgtttgttgtctaggttgtggtattgttcccgcaccgcaatatatagtagggagtcttggtacaggtcgtctgcactgattgcggggtagtgtccggctgttttggtgcatgcccggttgagtgtgcgtagatgatggtttgtggcccatccccacgatgcggtggtggccaggtctgcttttgttggtcgtctgctcatagcatctcttttatctggctatctgatagttgtttggtgttttgttgtggatagtgtagcacactagtccggggtggccggtggtgcctgtacggtgccggaaccatgtggattcgccttccatggatgggcattggatgaaggtgcgttgtccttgctcggatatttctaggtggtgtcggtggcctgccatgagtatgtgtgatgtggtgccgttgtggaattcttggccgcgccaccattcgtattgtttgccggtgcgccattggtgcccgtgggcgtgcaggatttgtgtgcctgccacgtctacggtggtggtcatttcgtctcggctggggaagtggaagtgtaggttggggtattggttgttgagctggtaggcttctgcgatggcgcggcagcagtctacgtcgaatgagtcgtcgtaggtggtgactcctttgccgaatcgtacggcttctccgtggttgcctgggatggatgtgatggtgacgttggcgcagtggtcgaacatgtggacgagttgcatcatggccatgcgggtgagcctgatttgttcggtgaggggtgtttgtgtgcgccaggcgttgttgccgccttgtgacacgtatccttcgatcatgtcgccgaggaatgcgatgtggactcgttgcggtttgcctgcttgctgccagtagtgttttgcgactatgagggagtgtaaatagttgtcggcgaagtgtgctgtttctcctccggggatgcctttgccgatttggaagtctcctgccccgatgacgaaggctgcagtgctgtagtcggtgtgggtgttctgttcgggtttggggggtgtccattcggctagtttgttgacgagttcgtctaccgggtaggggtttgttgcgggttggtggtcgatgattttttgtatggatcggcctgtttctccgttggggagtgtccattcggagatgcgtgtgcggcgtacagtaccattggctagattgtcgtcgatggtgtcgatggcgttgtcgtggttggctagctgtgtgagtagccggtctatattgtctatcactggttttcctcttctgttgtctgggtggtgttggcttgtttgcggcgatagtctttgatgacggtggcggagatggggtatcctgcctgggtgagctgttttgctagccatgaggcggggatagacctgtcggcgaggacgtctgcagctttgttgccgtagcgttggatgagggtttcagttttggttgccatgatgtcctatcggttgtgtggtgggttgccatcctgtgcggcagtcgccgtcgtgtcctggcttgcgtgtgcaccacgatacggttccgtctgtgtggttgagtgtttttccgcacatgacgttttgtagatgttccggcagctggtcggtgttgctatcgtcttgctcgtctagcaaagttttttgttgggtgaaaaactcggacacggtgccgttgtggactggtagtatccatgttttccattgttgttgtagccgagtgttccagtggaattgtttggccgcgttttcggcttgtttgatggttttgtagtagcctacaatgatccgctggtggttgttgtctggcttgtgtggccctttccagtattgggcggctacagcgtacctgttgttgtcggtgaagcgctgccagcagtactcgatgatgtgctgtagtacactatcgggaatgtcttgtgcttggttttcgtcgagccactcgtcgacaataatgttgcgtatggctcgcttgtctttggtggtgggtttgaacgagatgctcacagtacgggcctgtcgtcttgcatgaactggttgaaggtgctgttcccggcgtgttgggcttgtgtgatttgctggtcggtccagtctgggtgttgctgtttcagatagtgccagtggcaggcgttgtaggtttcgttttgtagccgtgtgagatggttttcggtgatgatttgtttccacattttccacgagacgtcgagtcgtttgagcatgtcgatggccggcacattaaacgagtcaaggaagagtatttcgtgggtgtagtagtttttctcgtaggcgtcccatccgcttcggtgcctgttgggctggtttttggggtagacttcccggcatactttgtgtaaccgtttggccatgtctttgggtagtttaatgtcggggttggcgcggatcatggatcgcatcccatcgtaggtggtgccccaggtgtgcatgatgtgtagtgggtcttcaccatcagcccatttttctgcacagatggcgaggcggatacgcctcctggctgtttggctggtgttgcggcggtgggggatggggcacgtgtcgaggggatccatgatgttttggtgtacctttcttggtttgggttgcttgcgtggttttactgtagcacagtgtctagtgcttgtgtcaaccctgtttttccggcctgtaggtaggtgtctgtgacgtcaccgagggtgaggggcacatgggtggcttgggggagtgccgcctggagggtttgggccatctggtctcctgctttgtctgggtcggaccatatgtagatgtggtcgtagccttcaaaaaatttggtccaaaagttttgccacgaggtggctccgggtagggcgacggccgaccatccgcattgttcgaggatcatggagtcgaattcgccttcgcagatgtgtatttcggctgccgggttggccatggcggccatgttgtagatggagcctgtgtccccggctggggttaggtatttggggtggttgtgggttttgcagtcgtgcgggagtgagcagcggaaacgcatttttcgtatttcggctgggccgccccaaacggggtacatgtatgggatggtgatgcactggttgtagttttcgtggccgggtatggggtcattgtcgatgtatccaaggtggtggtagcgggctgtttcttcgctgatgcctcttgctgagagcaggtcgagtatgttttcgaggtgggtttcgtagagggccgaggctttctggattcggcggcgttccgcaatgttgtatgggcgtatgctgtcgtacattcgggttttcttcttctaatcgttgttgtagtttggtgagtccgcctccgacaccgcatgtgtggcagtaccagacgcccttgtcgaggttgatgctcatggagggctggtggtcgtcgtggaacgggcagaggatgtgttgctcgtttttggacgggttgtagcggatgcggtaggtgtcgaggaggtggcaggtgtcagaggtgtgggaggagctcgttgagggttgataccacataggcttcgctccagggtttgttgcgctgtttcatgatgactaggccgatggtggattggtttttgcggtttcggtgggtttcgtagttgcgcgcctcaagggtggcttctttcacgaattgggctaggtgtggttgcccggctttcgcctcgataatgtaggttttgttgccggttttgaggatgaggtcgccttcgtcttcccttccgttgaggtggaggcgctctatatcatagccggtgtcgcgtagttggtggaggagtcttgtttcccattcggctccggccctgcggttgcgtgattgttgtgtcgccatcatagtcctttgtgtgttgtggtcatgttccagggctgtttttcgacgaggggtccgaagaatgtgtattcggggtaggctcgtagccgctcatattttgttccgtctgggctggatcgcccggtgcgctgtttgagcacggcgatgcgagcctctgccggtatcgataggccgttgccattatcctcgccaccatacaatgatactccgagaatgagttgtggtttttcggagagtccgtttttgatttcccggcgtgctggcgggtgttcgatgtcggagccggttttgtcggttgcgtggtgtgtgacaataatggtggagccggtgtctctgcctagtgctgtgatccattgcatggcttcttgttgggcttggtagtcggattcgcagtcttggatgtccatcaggttgtcgataacaatgagtggtgggaaggtgttccacatttccatgtaggcttgtagttccatggtgatgtcggtccaggtgatgggtgactggaatgagaatgtgatgtgttggccgtggtggatgctgtctcgatagtattctggcccgtagtcgtcgatgttttgttgtatttgggcggtggtgtgttgggtgttgagggagatgattcgtgtggaggcctcccagggtgtcatgtcccctgatatgtagagggctggctggttgagcatggcggtgatgaacatggctagcccggatttttggctgccggagcgccccgcgatcatgactaggtcccctttgtggatgtgcatgtcctggttgcggtagaggggttctagctggggtatgcggggcagctcggcggcggtttgggaggctctctcgaaggatcgttgtagagagagcatcggagccttaatctatctgtctatcggttggatgatgtgttggtggtcagatggagtcgatgtcgatatcagcatcagttgaggctgtggtgtcgtctagctggctgttatcgcgtttgtctacgtattcggcaaccttatcatagatggcatcatcaaggggtttgagcacgaccgcgttgaacccgtttttggtgcgcacggtggcgagtttgaaggcctgttcttcgccgagatatgcttctaggtcgcggatcatggagtgtgggcggtcgttgttgccgcgtgctttctcaataatagcgttggggatggtttctggggtgccgttgttgagatcgtctagggtgtggaagattgtgacatcggcgtagatgcggtctgcgacctgtccgccgtagccttcggtgttgtgttctacgtcgcggattttgaaggcgatggcggtggcgtcctggtttcgggaggggttgaagaaggtgctgttgctgttgtggttgcggtagttggcgagtcccatgattgttgtttcctttactgttgtgtctgtttttgttgtcttatattggtttatcgggtgaggctgtttcgtttgctgcggaacgcctcggacacgtcagggttgctggtgatggtctttttgtactgtttgaggaggtcggctagctgtgctttgctggtggctttgttgatccggtcaatgatgatgtcgttttcctgattggcgattttgtttacgtagtctttggcggcctgattgtatcggtcttggaggatgatggatgcgctcgctacgagtgttgcaaggtcccagtctttcgatacggtttcgtctttcaatcctcctagcaggtcgatgatagttttctttacctggtcggcggtgtctccgcggatgacggtccatggggcggcgtagtcgcctccgtatttgagggtgacggtgaatcggtcgtcgtctgcgttgtcggtcactggtgctccttgccttcttctgttggggctgtgatggtggtttctaccgggtacctgtaggcgtctttcccgttgacagcccagcaggcgtccttgacggggcagcctttgcagagtgctgtgacgtgtgggacgaagatgccttcgctgattcctttcattgcttgactatacatggatgatacatgccggtaggtgttgttgtcaaggtcatagagttcggtggatgtgccttgtgtcggggacttgtcgtcgttgcggctggtggctggcgtccaaaaaatgccttttgtcacattgttgccgtgttggttgagcatgtaccggtatgtgtgcaactgcatactgtcggcgggtaggcgtccggttttgaggtcgaggatgaaggtttcgccggtgtcggtgtcggtgaagatacggtcaatatatccgacaatagtggtgccatcctggagggtggtttctaccgggtattcgatgcctggctggccgtcaataacagcggtgatgtattctgggtggttgcgcctccagtttttccacctgtccacaaaggtggggccgtatatcatccaccaattgtagtcttttttgtgtggcccgcccgactcgcacatgtttttgcacaccctgccggagggtttgatttctgtgccttcggattcggcgagggcgacttgggtgtcgaaaatgtttttgaaggatgagagtttgtctggcagtgcagggtattcggcgggattgtacaggtgtaggtcgtattgttcggtgatgtggtgtatggcgcttccggcgatggtggcataccaggtgtggtgttgggcgtggtagccgtgttggaggcgccatttttctccgcattcggcccactgggtgagtgaactgtaggagatgtggcctggatggtggatggttttcgggtattgtgctaggggcattacttgtcgcttttgttccatgggttgcgggtgtcttggccggcctggtgttgctggtaggcgaggagtgctaggcagtgccaggcagcatgggccaggtggggtagcccggattcatcatcgaggttgtttccttgctgccatgataacaggtgccggtagagggcgtcgacactgtggctccacgggtagccgccggtccagttgttgtcgccgtatttggtggcaccgtagcctgccacggagccgagggcgtgcaaggctgcggggtcgatgagggagagcctgcaaagtttgagttcttttttggcaccggtgttggggtcggtgtacatgctggttggttcatccatggtgtgtgtgctccttgagtgtgggttactggttggggttgtgggctagggctacggcgaggatgatgatggcgagggtttcagcaataagtatgggtgttgtgatcatttagtgtctcggggattgttggtgagtgtggaggcgcctaggagggtggtgagggcgcatgcggcaataatggcgagggctgccttgtgtggggtgccggttgcgtacatccatgtgatgatggcgccctgtatccatgccagtgtggtgaagaacgtttcgtagctgtgtagctcaatgttgttgggtgtgttcatgcttgctcctgaagaatggtgttgatggttttataaatgttgtacaggttggtttcgatagataacagttggtggatttcgtggtcgagatcaatgtctgggttgagggtgttgatgcgggaggcaatatcggtggctgtgcgtagtgtgccgccggtgtggtgaatgatgtgtgccgtgtcggcgagtccggtggtgacagcgtagtgggagaggagaggcatagcggggatgctccttggcgggttactgttgcgggttgatgttgaggtctgtgacgtgcgggtggtcttctgttccggtgacgaggcagtggactgtgacgggtagtttggatgctcccggctggcggacggtggcgccgtagacgatggagaaggtgtctttaccaataattttgtggagttggaggtcgatgtcggggttgccgttccatttgacaccgtgtgcggcggcttgctgttcggctttgcggttgcaggtgtgtgctgccgtgatcatggtgagtccggtggcggtttcttcaccccttgcttgggcctgcttgtgggctttggcctgctcggctcgcagtgactgttctgcggcggcctgccgggctttcttttcggctttgcgctgttggacggttttgggggtccattcggtgttggctgtggtggcctgtggggctggctgtgaggcgagtggcggattgtcgtctggggctggcatgaatgaggcggcggcaatgatggcggctgtgatgcctgcgatggtgtagccgtttttcttgttcatgttttgtgtcccctttccggggtgttgttcgttgctgacatgattaatactttcagcggctgggccctgtgtcaaggctgcgctcagtttgtgtgagcgatacttgtgtggctaggggtgatggcttctttcgcccaataggatgtgccaccgctggtccagtatccgagtttgttgcgctgcatgcccttggcgtccatctcatccacggtgaggcacctgcggcgattggggccttccttgaccccgtgatcgcctacccgatgcatgtcgcctgaggtggtactcgtgaatgtttcgtggcagattgtgcagtgctctgacttgtatccgatgattgtgctatcgcacttgtggcatgtccattgcatgattgctcctattttccattataagactccctgtagtgccattttagcgccttgcgggtcttgggggtacaactatataggtcaggtatttctaagcgtttctaggcgattctaggctcattgtgtgcgactgaggtttatcgggcacacagggtgagcaggtggccaacattgatgcgggtcacattccagtagagttgcgtggcttcaccgccggtgagtggcttccactcatcatggctgaacacggtgccatcggtggcgatgaatgtgttggggcgtagcttgtggagttcaatctctacgctctgccggtaggcttcggcgaggcccccgaaatcgaggtggtcgcaggggaggttttcgaggcgtgtcaggtcgaagggtgtggggcagtcgtagctggcggggctgtagagctgggtgaagtggttggcgatcttctgcatcatgattccttttctggtgatggtgtgttgatggttttatcgtgtggattcggcgatgatagcgtcgaggtcgatcatgtcgatcatgtcgtggagttcctcagtctcatctggggtgagtggctgccagttgcgtggcccatacactgcaccgtcaagagtgatggtccacaggggccggatgagtcgtacggcttcttcgactttggcacggtataggcggcagatgatagacgtgtgggtgttacctatgtcacatcctgccaggtgtgcgggatggagtggattgatttctgtttgcccgtagaggctggtgaaggatggtgtgatgagtgtgccatccatgggtgatgttcctttctgggctgtctgggttggttgttgtggtttctagagtgtgtgggctgtgacctatagtcaaggctacgctcattcggattgagcgtttcatgtgggtgtggcatggaatctacacccccatactatgtgagataggccacatcctcctggcttggtgtgccatctcaaggccaccctgccaatctggcgtggagggtgtagcccagaaataccgtttaaagccttcacacggcgcctaggagcaccttacagggtgggggctaggtattcatacccccaagcaattctgatcgattctagacgcctacaggagcctcatacacgatcaaccatctcggcatagatcatcagcccctatcctgcttagctaagcctatactatgtggacagtgtgggatactgtagggggaagaaggacacggtaaaagaaagaagggggagcatcagccttcacaccttaaagtcttagcgcttagcaccgatggtcttagcagttagcaccgagcccctcaagggctcggcatcagcccgaacaggcacagccctgaaaggagtacacgccatcagggaaggcttgagagtacgaggagccctagcgacgagtactcgaaagcctgagggaacaccctcagcactgatgggcctagcgtgttcggaaaggacacaagagtcaaacgtgacagctatccgggagtgaaacccgttctgactaggggtttcagccttaaccacctgtaaaggttacaagactctaagaaaatttaaggaaaagtttaggtttaatttttggacctttactaccaaaaacacccgtttacacccctcaaacccgcctatagagccaaatccaccggtttgactcatcccaggtggggtatgataggctggacaggtagccagctggacgcaaggccagaaagtgctgacgcacttcccgacctcgcttaccatcagtctaccaaacacttaaagaccttaaggcttagcgctaagcccttaagaccttaacgcttagcaccgagccccctcaagggctcggcatcagccctaaggctttaacacttaaataaacatataaaccttaaaagctaagttaacatttaagtcttacacacttagcgctgagccctccaaggctcagcatcagtcttaggtacttaaggatctaagttactataaaagttttaaagtcttaaagtaactatataaccttaacagttaagttaactataaaaccttaaaggctaagcacttaaggttataaacttaacatcagtgtttaagacttaaagagttaaacacttaaagtaactataagactttaaaaacctcaagtcttaaagttaaccatcagtcttaaactttaatattataacctataagtcttaaagcttataagttataaaagttttagaagagctaaggggttaacttctttacttctcttctctctttggttctttctctcttctcttcttttcttcatcaggggagaagaggaaccttttgccgtcagcgctgatgggcttttcaccgtgtgactcgtgtgcttctggtcgcaagctcccatcgcgcactccccacactctgacacctgtgtccctttcaggcttggcgtgttcggctgaaggcgtacggcgtgtcatgctcacacccttaacaccgggtgagacttaaagtgtatattatatgtagaagactttaaaacctgtaaggtgttcccgctgagcccgtgtcctacaccgccaagcgctaagccttgaaacgcgaacacacacccaccccccttttttctttcgtgtccttctcttttgacacagctggggggtgatgtgatctttctcacatgtcaggggggtagtggagaaaacaaacaccccaccacaaacagaacacccctcaaacacacaaaacagggcctaggatcgatcagcagggcaagggcaaggtattcatacccccagacgattccaggccgttacaggggcaaataagacccgtacagggctaggcgaggaacagacacatcatggcacgcaccaaccgtacagccagccaagcccaccggcgctggcgggcaagactcatcacccaagcccgacagcaaggccaaaccgaatgcccactctgcggagcccagatagcctgggacacacatgacctgccaaccagccccgaagccgaccacatcacacccgtcagtaggggaggactcaacaccctcgacaacgggcaaatcatctgcagaacatgcaacagaagcaaaggcaatcgcagcgaaccaaacatcaagttccaacaacaaaccacaaaaaaccttgttccatggtgacaaacccgccaacccccaccggggacaccccctgcacacccgtgcaagacc

SEQ ID NO: 35 - DNA, 29266 bp, Unknown
  source: /note="Description of Unknown: Bacteriophage of P. acnes"
agtgaaatacctcccttttgtggatttgtctgtttgtcgattttttgtgttggtggtgagtgttgtgcagcctgagcttcctgatagtcgtgattggtgtggggagacgcgtcgttggtggcgtgtgtggggtgaggatccgcgtgccgggtttgtgtctgatgaggagtggttgtttctcatggatgctgcggtgttgcatgatgtggtgtggcgtgagggcagggcggaccttgtggcttcgctgcgtgctcatgtgaaggcgtttatgggcatgttggatcgttattcggttgatgtggcgtctggtggccgtggtgggggttctgcggtggcgatgattgaccggtataggaagcgtaggggggcctgagtaggtgtctggtgttgttgggtctcaggttcctcgtcatcgtgtggctgcggcgtattcggtgtctgctggcggtgatgctggggagttgggtcgtgcgtatgggttgacgcctgatccgtggcagcagcaggtgttggatgattggcttgctgtgggtggtaatggcaggcttgcttcgggtgtgtgtggtgtgtttgtgcctcgccagaatggcaagaatgctattttggagattgtggagttgtttaaggcgactattcagggtcgccgtattttgcatacggctcacgagttgaagtcggctcgtaaggcgtttatgcggttgaggtcgttttttgagaatgagcggcagtttcctgacttgtatcgtatggtgaagtcgattcgggcgacgaatggtcaggaggctattgtgttgcatcatccggattgtgccacgtttgagcgtaagtgtggttgtccgggttggggttcggttgagtttgtggcccgcagtcggggttctgctcgcgggtttacggttgatgatttggtgtgtgatgaggctcaggagttgtcggatgagcagttggaggctttgcttcctacggtgagtgctgccccgtctggtgatccgcagcagatttttcttggcacgccgcctgggccgttggcggacggtagcgtagtgttgcgtttgcgtgggcaggctttgtcgggtggtaaaaggtttgcgtggacggagttttcgattcctgacgagtctgatccggatgatgtgtcgcggcagtggcggaagttggcgggtgacactaatccggcgttgggtcgtcgtctgaattttgggaccgtaagtgatgagcatgagtcgatgtctgctgccgggtttgctcgggagcggcttggctggtgggatcgtggccagtcggctacgtctgttgttccggcggataagtgggctcagtctgctgtggatgaggcgagtctggttggcgggaaagtgtttggtgtctcgttttctcgttctggggatcgggttgctttggcgggtgccggccggactgatgctggggttcatgttgaggttattgatgggctgtcgggaacgattgttgatggtgtgggccggttggctgactggttggcggttcgttggggtgatactgaccggatcatggttgccgggtctggtgcggtgttgttgcagaaggcgttgacggatcgtggtattccgggccgtggcgtgatggttgccgatactggcacctatgtggaggcgtgtcaggcgtttcttgagggtgttcgttcgggtgttgtgtctcatcctcgtgctgattctcgccgtgacatgttggatattgctgtgaggtcggctgtgcagaagaagaaaggctctgcgtggggttggggttcctcgtttaaggatggttctgaggttcctttggaggctgtgtcgttggcgtttttgggggctaaacgtgttcgtcgtggctgtcgggagcgtagtggtaggaagcgggtgtctgtggtatgaacgtggacgagttggctctgattgagggcatgtacgatcgtatccaaaggttgtcttcgtggcattgccgtattgagggctactatgagggctctaatcgggtgcgtgatttgggggtggctattcctccggagttgcagcgtgtgcagacggtggtgtcgtggcctggtattgctgtggatgctttggaggagcgtctggattggcttggctggacgaatggtgacggctacggcctggatggtgtgtatgctgcgaatcggctatcaaccgcgtcatgcgacgtccaccttgatgcactaatttttgggttgtcgtttgttgcgatcattcctcatggggatgggtcggtgtctgttcgtccacagtcaccaaagaattgcacaggccggttttcggctgacgggtctcgtctggatgctggccttgtggtgcagcagacgtgtgatcctgaggttgttgaggcggagttgttgcttcctgatgtgattgttcaggtggagcggcggggttcgcgtgagtgggcggagacgggccgtatcgtgaatgtgcttggtgcggttccgttggtgccgattgtgaatcgtcgccgtacttctaggattgatggccgttcggagattacccggtcgatcagggcttacacggatgaagcggttaggactttgcttgggcagtctgtgaatcgtgacttctatgcctatccgcaaaggtgggttacgggtgtgtcggctgacgagttttcgcagcctggctgggtcctgtcgatggcttctgtgtgggctgtggataaggatgatgacggtgacactccgaatgtggggtcgtttcctgtgaattctcctacaccgtattcggatcagatgcggctgttggcgcagttgactgcgggtgaggctgcggttccggaacgctatttcgggtttatcacgtctaacccgcctagtggggaggctttggctgccgaggagtctcggcttgtgaagcgtgccgagcggcgtcagacgtcgtttggtcagggctggctgtcggttggtttcctggctgcgagggcgcttgattcgagtgttgatgaggccgcgtttttcggtgatgtgggtttgcgttggcgtgatgcttcaacacctactcgggcggctacggcggatgctgtgacgaagcttgttggtgccggtattttgcccgcggattctcggacagtgttggagatgttggggcttgatgatgtgcaggttgaggctgtgatgcggcatcgtgccgagtcttcggatccgttggcggcgctggctggggctatatcgcgtcaaactaacgaggtatgataggcgatggcttcgggtgctatgtcgaggcttgctgccaccgggtatcagcgtgaggcggtcaggtttgccgggaagtatgctgggtattatgccgagcttggtcgtttgtggcattccgggaagatgacagatgcgcagtatgtgcgtttgtgtgtggagttggagcgtgccggccatgatggttcggcgtcgttggctgccaggtttgtgcaggattttcgccggttgaatggtgtggatccgggtttgattgtgtatgacgagtttgatgctgccgccgcgttggctaggtcgttttcgactatgaagattcttaagagtgacccggatagggtgaatgacacgattgatgcgatggctgcgggtgttaatcgggctgtcatgaatgctggccgtgacacggttgagtggtcggcgggtgcgcagggtaggtcttggcgtcgggtgacggatggtgatccgtgtgctttttgtgccatgttggctacgaggtcggattatacgactaaggaaagggcgctcacgactggtcatactcggcgtcataagcgtggtggtaagcgtccgtttggttcgaagtatcatgatcattgtggttgtacggtggttgaggttgttggcccttgggaaccaaatagggctgatgccgggtatcagaggacgtacgagaaggcccgtgagtgggttgatgatcatgggttgcagcagtcgcctagcaatattttgaaggctatgcgtactgttggcggcatgagataatttgatgtggtttccggttgtgtgccgccggttatcggtgcacagggttgtctcccgcacgggggtcaacaatgttgtgttgttttccgcaaggagtgtagggttaggctatggccgatcagagtgttgaggaacagaatgttgacaatgatgctgtggagtccggaaaggataacggcattgttgatacagtaaaagacgatggcgggcaggaggtagccgacaatcagtggaagaatgaaggcgagggtaaatcgccggggactgattggaaggcggaggcccgtaagtgggagtctcgtgctaaaagtaatttcgccgagttggagaagcttcgcgcctcggatggcgatgcggggtctgtgattgatgatcttcgccgcaagaatgaggaactcgaagacaggatcaacgggtttgttcttgagggtgtgaagcgcgaggtggctgccgagtgtggcctgtcgggtgatgctgtcgcttttctgcacggtgatgatcgtgacgcactggtggagtctgctaaggctttgaagggtttgatcgaccatagtagtggtggcgcgggtgtgcgccgtcttgcggggagtgcccccgttgatgatgttaaacgacgtgagggtgtcgcgtttgtggatgctcttgtcaataattctaggagatgatttgtgatggctgacgattttctttctgcagggaagcttgagcttcctggttctatgattggtgcggttcgtgaccgtgctatcgattctggtgttttggcgaaactgtcgccggagcagccgactattttcggccctgtgaagggtgccgtgtttagtggtgttcctcgcgcgaagattgttggtgagggcgaggttaagccttccgctagcgttgatgtttctgcgtttactgctcagcctatcaaggttgtgactcagcagcgtgtttcggacgagtttatgtgggctgatgctgattaccgtctgggtgtgcttcaggatctgatttcgcctgctcttggtgcttcgattggtcgcgccgttgatctgattgctttccatggtattgatcctgctactgggaagcctgcggctgctgtcaaggtgtcgctggataagacgaatcatgttgttgatgcaaccgatagcgctacgactgatcttgttaaggcggttgggctgattgctggtgctggtttgcaggttcctaacggtgttgctttggatccggcgttctcgtttgctctgtctactgaggtgtatccgaaggggtctccgcttgccggccagcctatgtatcctgccgccgggttcgccggtttggataattggcgcggcctgaatgttggtgcttcttcgactgtttctggcgccccggagatgtcgcctgcctctggtgttaaggctattgttggtgatttctcgcgtgttcattggggtttccagcgtaacttcccgatcgagcttatcgagtatggtgacccggatcagactgggcgtgacctgaagggccataatgaggttatggttcgtgccgaggctgtgctgtatgtggctatcgagtcgcttgattcgtttgctgttgtgaaggagaaggctgccccgaagcctaatccgccggccgagaactgatttattgttgcggtgatgtgtcaatgtgcagggggtggtgttgatgggtatcattttgaagcctgaggatattgagcctttcgccgatattcctagagagaagcttgaggcgatgatcgccgatgtggaggctgtggctgtcagtgtcgccccctgtatcgctaaaccggatttcaaatacaaggatgccgctaaggctattctgcgcagggctttgctgcgctggaatgatactggcgtgtcgggtcaggtgcagtatgagtctgcgggtcctttcgctcagactacacggtctagtactcccacgaacttgttgtggccttctgagattgccgcgttgaagaagctgtgtgagggtgatggtggggctggtaaagcgttcactattacaccgaccatgaggagtagtgtgaatcattctgaggtgtgttccacggtgtggggtgatggttgctcatgcgggtctgatattaacggctacgctggccctttgtgggagatatgatatgaccagttttccttatggtgaaacggttgtgatgcttcaaccgactgttcgtgtcgatgatcttggcgacaagtttgaggattggggtcatcctgtcgagactgtgtttcataacgtggccatctatgcttccgtttcgcaggaggatgaggccgcggggcgtgactctgactatgagcattggtcgatgcttttcaagcagtctgttgtgggtgctgattatcgttgccggtggcgtatccggggtgtggtgtgggaggctgacgggtctcctatcgtgtggcatcatccgatgtctggctgggatgcgggcacgcagatcaatgtgaagcgtaagaagggctgatagattgtggctcaggatgtgaatgtgaagctgaacttgccgggtatccgtgaggtgttgaagtctcctggggtgcagtcgatgttggctgagcgtggcgagcgtgtcaagcgtgcggcctcggcgaatgtgggcggtaacgctttcgataaggcccaataccgtgcaggtttgtcgtcggaggtgcaggttcaccgtgtggaggctgtggcccgtattggcaccacctataagggtgggaagcgtattgaggcgaagcatggcacgctggctaggtcgattggggcggcgtcgtgatcgtctacgatgaccccaggaagtgggctaaacgcgtgctcaaggatgatggctggctgtctgggataccgtgtacagggacagtgccggatagctttgagggtgacctgatttggcttgcgttggatggtggcccgcagttgcatgtgcgtgagcgtgtttttttgcgggtgaatgttttctcggatacgcctgatcgtgctatgagcctgtcgaggcgtgttgaggctgtcttggctgatggtgtggacggtgaccctgtagtgttttgtaggcgttctactggccctgatttgctggttgatggtgcacgttttgatgtgtattcgctgttcgagctgatatgcaggcctgtcgaatctgagtaaacgtatttgtttttgttttaatgtaattgtttgatatttaatgggggttgtgatggctgcaacacgtaaagcgtctaatgttcgctctgctgttacgggtgatgtctatattggtgccgctcatgcgggtgatactattgatggtgtgaagacggttcctgatgggttgactgctttagggtatctgtcggatgacgggtttaagattaagcccgagcgtaaaacggatgatttgaaggcttggcagaatgcggatgttgttcgcacggtggctacggagtcgtctatcgagatttctttccagctgatcgaatccaagaaagaggttatcgagctgttttggcagtcgaaggttactgccggagccgattcgggttcgttcgatatttctccaggtgccacgacgggtgttcacgccctgttgatggatattgttgatggtgatcaggttattcgctactatttccccgaggttgagcttatcgatcgtgacgagatcaagggcaagaatggcgaagtgtacgggtatggtgtgacgttgaaggcgtatcctgcccagattaataagaagggtgatgcggtgtctggtcgggggtggatgacggctttaaaagctgatactcctccttctccgaagcctcagccggatccgaatccgccttctgagaactgatacacgattttaagggattgttgataaatgagtgacacaggttacacgttgaagattggtgaccgtagctgggtgttggcggatgcggaggagacggctcaggctgttcctgcccgcgtgtttcgccgtgccgccaggattgcccagtcgggggagtctgcggatttcgcccaggttgaggtgatgttttctatgttggaggctgccgccccggctgacgcggtggaggccctggaggggcttcctatggttcgtgttgccgagattttccgtcagtggatggaatacaagcctgacggaaagggtgcctctttgggggaatagtttggctccacggcctgattgatgattatcgtggggccatcgaatacgattttcgcactaaatttggtgtttctgtttatgatgttggtggcccgcagatgtgttggggtgaggctgtccggctggctggcgtgttgtgtactgacacgtctagccagttggcggcccacctgaatggttggcagcgcccgtttgagtggtgcgagtgggctgtactggacatgttggatcattacaggtctgctaatagtgaggggcagccggagcctgtggcgaggccgacggatgagcgtagggcccgttttacgtctgggcaggtggacgatattttggcgcgtgttcgtgccggtggcggggtgtctcgcgagattaatattatggggtgaatagtgtatgtctggtgagattgcttccgcatatgtgtcgttgtatacgaagatgcctggtttgaaggcggatgttggtaaacagctttctggggtgatgcctgcggagggtcagcgttcgggtagtctttttgctaagggcatgaagttggctttgggtggcgccgcaatgatgggcgctattagtgttgctaagaagggcctcaagtcgatttatgatgtgactattggtggcggtattgctagggcgatggctatcgatgaggctcaggctaagttgactggtttgggtcatacgtcttctgacacgtcttcgattatgaattcggctattgaggctgtgacgggtacgtcgtatgcgttgggggatgcggcgtctacggctgcggcgttgtctgcttcgggtgtgaagtctggcgggcagatgacggatgtgttgaagactgtcgccgatgtgtcttatatttcgggtaagtcgtttcaggatacgggcgctatttttacgtctgtgatggctcgcggtaagttgcagggcgatgacatgttgcagcttacgatggcgggtgttcctgtgctgtctttgcttgccaggcagacgggtaaaacgtcggctgaggtgtcgcagatggtgtcgaaggggcagattgattttgccacgtttgcggctgcgatgaagcttggtatgggtggtgctgcgcaggcgtctggtaagacgtttgagggcgctatgaagaatgttaagggcgccctgggttatcttggtgctacggctatggcgccgtttcttaacggcctgcgtcagatttttgttgcgttgaatccggttattaagtcggtgacggattctgtgaagccgatgtttgctgccgtcgatgctggtattcagcgtatgatgccgtctattttggcgtggattaatcgtatgccgggcatgatcactcgaatgaatgcacagatgcgcgccaaggtggagcagttgaagggcgtttttgcgaggctgcatttgcctgtccctaaggtgaatttgggtgccatgtttgctggcggcaccgcagtgtttggtattgttgctgtgggtgtggggaagcttgttgcggggtttgccccgttggcggtgtcgttgaagaatctgttgccgtcgtttggtgctttgaggggtgccgctggggggcttggtggcgtgtttcgcgccctgggtggccctgttggtattgtgatcggcttgtttgctgccatgtttgctacgaatgcccagttccgtgccgctgtgatgcagcttgtgggggttgttggccgggctttggggcagattatggtcgctattcagccactgttcgggattgttgctggcgtggttgccaggttggctcccgtttttggccagattatcggtatggttgctggtttggctgcccggctggtgcctgttattggtatgcttattgcccggctggttcctgttatcacccagattattggtatggtaacccaggttgctgccatgttgttgcctatgctgatgccggttattcaggctgttgttgctgtgatacggcaggttattggtgtgatcatgcagttggtgcctgttttgatgcctgtgattcaacagattttgggtgctgtcatgtctattttgccgtcgattgttggtttgatacggtcgctgataccggtgatcatgtcgattatgcgtgtggtggtgcaggttgttggtgccgtgctacaggtggtggcccgtattattccggttgttatgccgatttatgtttcggtgattggattcattgccaagatttatgctgcggttatcgtttttgaggctaaggttattggcgctattcttcgtactattacgtggattgtgaatcattcagtgtctggcgtgaggtctatgggcacggccatcctgaatggctggaatcatattagagcgtttacgtcagcgtttattaacggtttcaagtcgatcatttctggcggcgtgaacgcggttgtggggttttttgcccggcttggttcttctgttgcctcccatgtgaggtctggttttaacgcggcccgtggcgctgtttcttctgcgatgaatgctatccggagtgttgtgtcgtcggtggcgtctgctgttggcgggtttttcgggtcgatggcgtctagggttcgtagtggtgctgtgcgcgggtttaatggtgcccggagtgcggcctctagtgctatgcatgctatgggctcggctgtgtctagtggtgtgcatggtgtgctggggtttttccggaatttgcctggtaatattaggcgtgcgcttggtagtatggggtctttgttggtgtcggctggccgtgatgtggtgtctggtttgggtaatggtatcaagaatgctatgagtggcctgttggatacggtgcgtaatatgggttctcaggttgcgagtgcggcgaagtcggttttgggtattcattccccgtcgagggtgtttcgtgaccaggttggccggcaggttgttgccggtttggctgaggggatcaccgggaatgcgggtttggcgttggatgcgatgtcgggtgtggctggacggctgcctgatgcggttgatgcccggtttggtgtgcgatcgtcggtgggctcgtttaccccgtatggcaggtatcagcgtgctaagggtgagagtgttgtggtgaatgtgaatgggcctacttatggtgatcctaacgagtttgcgaagcggattgagcggcagcagcgtgacgcgttgaacgcgttggcttacgtgtgattgcggggtgtggttcatgtttattcctaacccgtctgatcgtgccggtttgacggtggattggacgatgtttccgttgattggtaatgatccggagcgtgttcttcatttgacggattatacgggtgcgtccccggtcatgttgttgaatgattcgttgcgcggtttgggtgttcccgaggtggagcatttttctcaaactcatgttggggtgcacggctcggagtggcgcgggtttaatgtgaagcctcgcgaggtgacgctgccggtgttggtgtcgggtgttggtgaggatcctgcgggcgggtttcgtgacggttttttgacagcttatgacgagttgtggtctgcgtttcctcccgggggggagggggagttgtctgtgaagactcctgccggtcgtgagcgtgtgttgaaatgccggtttgattcggctgatgacacgtttacggttgatccggtgaatcgtggctatgcgcgttatctgttgcatttgacggcttatgacccgttttggtatggggatgagcagaagtttcgttttagtaacgcgaagttgcaggattggctgggtggcggccccgtcggcaagaagggtacagcgtttcctgtggtgttgacgcctggtgttggttctggctgggataatttgtctaataagggtgatgtgcctgcgtggcctgtgattcgtgttgaggggcctttggagtcgtggtctgtgcagattgatggtttgcgcgtgtcttcggattggcctgtcgaggagtatgattggattactattgatacggatcctcgtaaacagtctgcattgttgaacgggtttgaggatgtgatggatcgtttgaccgagtgggagtttgcgcctatcccgcctggcggttcgaagagtgtgaatattgagatggttggtttgggtgccattgttgtgtcggtgcagtacaggtttttgagggcttggtgaatagttgatggctggtcttgttccgcagataacattgtttacgccggattatcaccgggtggcgcctatcaatttttttgagtcgttgaagttgtcgttgaagtggaatggtttgtcgacgctggagttggtgttgtctggggatcattctaggttggatgcgttgactaagccgggggcgcggctggttgttgattatggtggtggccagattttttctgggcctgtgcgtagggttcatggtgtgggtccgtggcgttcttcccgtgtgactatcacgtgtgaggatgatattcgcctgttgtggcgtatgttgatgtggcctgtgaattatcgtcctggtttggtgggtatggagtggcatgccgacagggattatgcccattattcgggtgcggcggagtcggtggctaagcaggtgttgggggataatgcttggcgttttccgcctggtttgtttatgaacgatgatgagagtcgtggccgctatattaaggattttcaggtgcggttccacttgtttgccgataagttgttgccggtgttgtcgtgggctaggatgactgtcacggtgaaccagtttgagaataaggtgaaggatcagcggggtttggtgtttgattgtgtgcctgctgtgacccggaagcatgtgttgactgccgagtctggttcgattgtgtcgtgggagtatgtgcgtgacgccccgaaggctacttcggtggtggttggtggccgcggcgagggcaaggatcggctgttttgtgaggattttgacgcgttggccgaggacgagtggtttgatcatgtcgaggtgtttaaggatgcccgtaacacggattctgagcatgtgcatctcattgatgaggctgagcaggtgctgtccgagttaggggccacgtcggggtttaagatcgagttggctgagtcggatgtgttgcggtttgggccaggcaatctgatgccgggtgatttgatctatgtggatgtgggttctgggcctattgcggagattgtgcggcagattgatgtggagtgtgtatcgcctggtgatggttggacgaaggtgacaccggttgcgggggattatgaggataatccgtcggccctgttggctcgccgtgtggctggtttggctgcgggtgtgcgggatttgcaaaagttttagtaagtgattggggtttgttgtgggtattgtgtgtaacgggtttgatggtgtgttgaccgagtatgattgggctcaaatgtctggtctgatgggtaatatgccgtcggttaagggcccggacgattttcgtgtcggcacgacgattcagggtgccacagtgttgtgtgaggtttcgccggggcaggcttgggctcacggggtgatgtgcacgtcgaatagtgttgagacggtgacggggcagcttccgggcccgggggagacccgttatgactatgtggtgttgtctcgggattgggagcagaacacggccaggttggagattgttcagggtggccgtgcggagcgtgccagggatgtgttgcgtgccgagcctggcgtgtaccatcagcaactgttggctactttggtgttgtcgtctaacgggttgcagcagcagttggataggcgtgctgttgcggctagggttgcgtttggggagtctgctgcgtgtgatcctacccctgtggagggtgaccgtgtgatggtgccttcgggggctgtgtgggctaaccatgccggcgagtggatgctgttgtccccgcgtatcgaaacgggttctaagtcgatcatgtttggcgggtctgccgtgtatgcttacacgatcccgtttgagcggccgtttagcgctccgccggttgtggtggcgtctatggctacggcggctgggggtacgcagcagattgatgtgaaagcctacaatattactaataaggattttagtttagcgtttattacgaatgatggttctaagccgaatggtgtgcctgcggttgcgaattggattgctgtgggcgtgtgaccgggctgttgttgtggcggatggtgtgatgttggggggctgtggtgtcgtggtttactcctgcactggtggcctctatttgtaccgcattggccacgattttgggttctgttcaggcggttacttacaggtcgaagaagaggcttaggcagttgtctgcgcaggttgatgcgatggaagaatacacgtggaatattcgccatattgttcaccgctataacgcgaatctgccggagaatgttgagccggtaaagatgcctgatttgcccgagtttttgaaggatactgttgatggtggtggggggtgaattgtgagggagttggaggaggagaagcggcagcgccgctcgtttgagaaggcttccctgatactgctgttcctgtcgcttgtactactagcggtggttgctgggggtgctttgcggtacgggtctgtggcttcccaaagggattcggagcaggctaaagcccagtcgaatggtacagccgccaagggtttggctgcccgtgtgaagcgggtgtgtgcctctggcgggcaggagtcggtgcggcttcaccagtctggcttgtgtgtggatgctcagcgtgttgagcgtagcgtgcagggtgtgcctggccctgccggtgagcgtggcccgcaaggcccgcaggggccgcaggggccggctggtgttgatggttcggctgggctggttggccctgttggtccgcagggttccccgggtttgaatggtgtgaaaggtcctgacgggttgcctggcgctaacggttcggatggccatgatggtgttgctggccgtgcaggtgtcgccggtgtgaacggatccgatggcaaggatggtcgggatggttcggctggtgagcgcggtgatgtgggcccttcaggtcctgccggcccgcaaggtgcacagggtgaacggggtgagcgcggccccgccggtgtgaacggatccgatggcaaggatggtaaagatggtaaggatgggcgctcggtggtgtctgtgtactgttctggggggcgcctgtttgtgaaatatagtgacggtgcggcttctaccgtgtcgggttcggtggcttgtgagagtgtgaaaccatcacctgtggttaccgtgtcatcccgcaagtaaaaaaagaaaagggaagggtgttactagtgttggtcgtgtttgggggtggtgtgtggtgagatacattccagcggcgcatcactcggccggttcgaatagtccggtgaatagggttgtgattcatgcgacatgcccggatgtggggtttccgtccgcttcgcgcaaggggcgggcggtgtctacagcaaactattttgcttccccatcgtcggggggttcggcgcattatgtgtgcgatattggggagacggtgcagtgcttgtcggagtctacgattgggtggcatgccccgccgaatccgcatagtttgggtatcgagatttgcgcggatgggggttcgcacgcctcgtttagggtgccaggccatgcttacactcgggagcagtggcttgatccgcgggtgtggcctgcggtggagaaggctgccatcctgtgtagacgtttgtgtgacaaatataatgttccgaaaaggaagcttagtgcagccgatttgaaggccggtaaacgtggtgtttgcgggcatgtggatgttacggatgcgtggcatcagtcggatcatgacgatcctgggccgtggtttccgtgggacaggtttatggccgtagtctgcggcggtagtagtagtgatagtggggagttaactgtggctgatgtgaaagccttgcatgatcagattaaacaattgtctgctcagcttagtggttcggtgaataagctgcaccatgatgtgggtgtggttcaggttcagaatggtgacctggcgcgccgtgtggaggccttgtcgtgggtgaagaatccggtgacggggaagctgtggcgcaccaaggatgctttgtggagtgtctggtattacgtgctggagtgtcgcagccgtatagacaggcttgagtctgctgtcaatggtttgaaaaagtgatggtggtttgttgtgggtaaacagttttggttgggcttgtttgagcgtgccctgaaaacttttattcaaacgtttgttgctgtgcttggggtgacggcgggtgtcacgtatactgcggagtcgtttcgcggtttgccgtgggagtctgccctgattacagccggggtggcggcaatactgtcggttgctacatcgtttggtaatccgtcgtttgtggccggtaaacctaaaaccacggttgtggatgctgggcttgttccatccgatgatgggggcatggttgagccgcatatggtggacgtaacggatcctggcatgatagagcctatcgacgatgccgatgctggaggctatgtgccgaggcgtgcagccgaggctgaggttggcacggtagagtctactgttgcataattgaatatgtgtgtgtgccccagcggtgctgccacgatcgtgtggtggttgccgctggggcactatttctgtttatgcggtgtggctatgattcgtttctgtcgatggtgtcttcgagcatctgatacaggtggaggcaggtagagatagtttcgctggcctggtctagaacgttccggccgataacgtttttgtggttgtcgcggtggcggatgatagcccacatgatctcgtcggctgccgcctgcaatagttttgcctggtatgcgattccggcgagccagtctagtgcttcctggcttgcataggggctatggtcctcgctgttgccacgggtgttgctgttgtttgtggggtgtcctgcactgtcgcataaccacaggatttcgctgcactcgtctagcgtgtcctggtcgatagcaagatcgtcgaggctgacttcgttgacggtaaggttcacgttgtcgagggagatgggtacaccgtactggttttcgacactgtcaacaatgtttttcagctgttgcatgttggtgggctgttgttggacgatgcggtgtatcgctgtgttgagggtggtgtaggtgatattgtgtgtgttgttcatcgtgttatgccattccttcgttatcgtctggcatgtagtatcgactgtttgcgtactcggttaacgtcatcagtgtttggtctgcccactgtttcacagtctgccgggtcacacccaatcgttgggcggccgacgcataggtttgatcatacccgtagacttccctgaatgcggcaagccgtgctagccgtttccgctgtttggatggttcacatgtgagggtgtagtcgtcgatggccagttgtagatcgatcatggtgacgatgttgttgccgtggtgttgtggcgcggttggtgggggtggcatgcccggctctacactcggtttccatgggccgcagttccagatccattgggcggcttggatgatgtcggcggtggtgtaggtttggttcactggtcaccccttgaataggttgtcgaggttgtctgggttgctggtgttggtggtgtcgaatcgtccgacgcagtggcagtagtcgtacatgagtttgataatgtgttggtggtcgccgaggtaggtgtttccgctgatgctgtaggtggctgtgccgtctttgctgatggtgtatttggcggtgatggtttcgggtgtttcggtgttggtgatgatggcggtggtggtggagcctactgtttgtagcctggtggtttgggttccgtcgtcgaggatggtagtaaccatgagggttgtcctttagatgctggtttggttgtcggctagatgaataatatcggataaaggtttcggctggtctaggtgttgtatggttttgttggctagccgtttggctaccctgtaacacattttggtgtagtgtttgttgtctaggttgtggtattgttcccgcaccgcaatatatagtagggagtcttggtacaggtcgtctgcactgattgcggggtagtgtccggctgttttggtgcatgcccggttgagtgtgcggagatgatggtctgtggcccatccccacgatgcggtggtggccaggtcggcttttgttggtcgtctgctcatagcatctcttttatctggctatctggtagttgtttggtgttttattatgtatagtgtagcacacgagtccggggttgccggtggcgcctgtgcggtgtcggtaccagactgattctccttccattgatgggcattggatgaaggtgcgttgtccttgctcggagatttcgaggtggtgtcggtgtcctgccatgagtatgtgtgatgtggttccgttgtggaattcttggccgcgccaccattcgtagtgttggttgttgcgccattggtgcccgtgggcgtgcaggatggtagccccggctacgtttacggtggtggtcatttcgtcccgctgggggaagtggaagtggaggttggggtagttgttggtgagttggtaggcttctgcgatggcgcggcagcagtccacgtcgaaggagtcgtcgtaggtggtgactcctttgccgaatcgtacggcttctccgtggttgccggggatggatgtgatggtgacgttggcgcagtggtcgaattggtgtatgagttgcatcatggccatgcgggtgagtctgatttgttccgtcaagggtgtttgggtgcgccaggcgttgttgcctccttgtgacacgtatccttcgatcatgtcgccgaggaatgcgatgtggactctttgcggctgcccggcttgctgccagtagtgtttggtggctgccagtgagcgcaggtagtcgtcggcgaagtgtgctgtttctcctccggggatgcctttgccgatttggaagtcgcctgccccgatgacgaaggctgtctcgtcactgctttgggtgtcttgttcgggtttgggtggctgccattcggctagtttatcgacgagttcgtcgaccgggtaggggtcggttgcgggttggtggtcgatgattttttgtatggatcggcctgtttctccgttcggtaaggtccattcggagatgcgtgtgcgccgcacggttccgttggctagatcatcattaatggtgtcgatggcgttgtcgtggttggctagctgtgtgaggagccggtcaatattgtctatcactggttttcctcctccttctgggtgttggtttgtttgcggcgatagtctttaataacggtggcggagatggggtatcctgcctgggtgagcatttgggctagctgtgtggcgggtatagacctgtcggcgagcacgtcggctgctttgttgccgtagcgttgaataagggtttcagttttggttgccatggtgtcctatcggttgtgtggtgggctgccatcctgtgcggcagtcgccgtcgtgtcctggtttgcgtgtgcaccacgatgttgttccgtctgtgtggttgagtgttttgccgcacatgacgttttgtagatgctccggcagctcgctattgctatcgtcttgctcgtctagcaaagttttttgttgggtgaaaaactcggacacggtgccgttgtggactgggagtatccatgttttccattgttgttgcatccgggtgttccagtggaattgtttggcggcgttttctgcctgttttatggttttgtagtagccgacgagtatgcgctggtgcggctggtcgggcgggttttggcctcgccagtattgtgctgcgacggcgtaacggttgttttctgtgaaggtgttccagcagtattcgataatgttgttgagtgtgtcgtctgtaacatctatgtcgctgtttagtgtttcttgggcgatgatgtcgcggatggcttgccgatttttggtggtgggtttgaaggtgatgctcacgatagtaccggctcgtcttgcaggaactggttgaaggagccgtctccagcatgttgtgcctgtgtgatgtcctggtcggtccagtcggggtgctgctgtttcagatagtgccagtggcacgcattgtatgtttcgttttgtagccgtgtgagatggttttcttcgatgatttgtttccacatggtccatgacacgtcgagccggttgaggatttcgagggctgggatgttgaattggttgaggaacaggatttcgtgggtgtagtattccttctcgtattggtcccatccgcttcggtgcctgttgggctggtttttggggtaggcttcccggcatactttgtgcaaatgtttggccatgtcgtcgggtagtttaatgtcggggttggcgcggatcatggatcgcatcccatcataggtggtgccccaggtgtgcatgatatgtagtgggttttctccatcagcccatttttctgcacagatggcgaggcggatacgcctcctagtggccttactcgtgtcgcggcggccggggatggggcacgtgtcgaggggatccatgatgctttttatgcctttctttgttgggggttgcttgtgtggttttactgtagcacagtgtcgagtgcttgtgtcaaccctgtttttccggcctgcagataggtgtctgtgacatcccccagggtgaggggcacatgggtggcttgggggagtgctgcctggatggtttgtgccatctgttcgcctgccgggtctgggtctgaccagatgtagatgtggtcgtagccttcgaagaattttgtccaaaagttttgccacgaggttgcgccgggtagggcgacggcgggccatccgcattgttcgaggatcatggagtcgaattcgccttcgcaaatgtgcatttcggctgccgggttggccatggcggccatgttgtatatggagcctgtgtcccctgccggtgtcaaatatttggggtggttgtgggttttgcagtcgtgtgggagtgagcagcggaaacgcatttttcgtatttcggctggcttgccccaaacggggtacatgtaggggatggtgatgcactggttgtagttttcgtggcctgggatggggtcattgtcgatgtatccaaggtggtggtagcgggctgtttcttcgctgatgcctcttgccgagagcaggtcgagtatgttttcgaggtgggtttcgtagcggactgaggctttctggattcggcggcgctccgcaatattgtatgggcgtatgctgtcgtacattcgggtttctttcttctaatcgttgttgtagctgggcgagtccgcctccgacaccgcatgtgtggcagtaccagacgcccttgtcgaggttgatgctcatggagggctggtggtcgtcatggaacgggcagaggatgtgttgctcgtttcgtgacggattgtagcgtatccggtaggtgtcgaggaggcggcaggtgtcagaggtgtgggaggagctcgttgagggttgataccacataggcttcgctccagggtttgttgcgctgtttcatgatgacgagtccgatggtggactggttttcgcggtttcggtgggtttcgtagttgcgtgcctcccggctggcttgtttcacgaattgggcgaggtgtggctggccggctttggcttcgatcacataggtgtggttgccggttgtgaggatgaggtcgccttcgtcttctcgcccgttgaggtggaggcgttcgatattgtggccggtgtcgcgtagctggtggaggagtctcgtttcccattctgcgccggcccgccggttgcgtgcctgttgtgtggccatcatagtcctttgtgtgttgtggtcatgttccagggctgtttttctacgagtggcccgaagaatgtgtattcggggtaggctctgagtctttcgtatcgggtgccgtctgggctggatttgccggtgcgctgttttagcacggcgatgcgcgcctctgccggtatcgtgagcccgttgccgttatcttcgccaccatacaatgagactccgaggatgagttgtggtttttcggagaggccgtttttgatttcccgcctggctggcgggtgttcaatatcggtgccggttttgtcggttgcgtggtgtgtgacaataatggtggatcctgtgtcgcggcctagcgctgtgatccattgcatggcttcttgctgtgcctggtagtcggattcgcagtcttggatgtccatgaggttgtcgataacaatgatgggcgggaaggtgttccacatttccatgtaggcttgcagctccatggtgatgtctgtccatgtgatgggtgactggaacgagaatgtgatgtgttggccgtggtggatgctgtctcgatagtattctggcccgtagtcgtcgatgttttgttgtatttgctgggtggtgtgttgggtgttgagtgagatgattcgtgtggaggcctcccagggtgtcatgtcccctgatatgtagagggcgggctggttgagcatggcggtgatgaacatggctagcccggatttttggctgccggagcgccccgcaatcatgacgagatcccctttgtggatgtgcatgtccaggttgcggtagaggggttctagttgtggtatacggggcagttcggcggcggtttgggaggctctctcgaaggatcgttgtagagagagcatcggaaccttatctatctgttacggtttgggcggagagtggtggtcagatggagtcgatgtccacatcatcactgcccgtggtgttgggctggctgtctcgcttgtcaacatatgctgctacgaggtcgtagatggcgtcatccaatggtttgagaataacggcgttgaacccgtttttggtgcgcacagtggctagtttgaaggcctgctcttctcccaggtaggtttcgagttcgcggatcatggagtgtggccggtcgttgttgcctcgcgctttctcaatgatagcgttggggatggtttctggggtgccgttgttgagatcatctagggtgtggaagatggtcacatcagcgtagatgcggtctgcggtctgtccgccgtagccttcagtgttgtgctgcacgtcgtggattttgaaggcgatggcggtggcgtcctggtttcgggacgggttgaagaaggtgctgttgctgttgttgcggtagttggcgagtcccataactgttttccttttactgtttatgtttggttttgttggtttgtgtcggtttttatcgggtgaggctgttgcgtttgctgcggaaggcctctgacacgtcactgttactggtaataatctttttgtactgtttcaaaaggtcggctagctgtgtcttgctggttgcgttgctgattttgtcgatgacgatggtgttttcttgggatgcgatgttgtctacatagtttttggcggcctgatcgtatcggtcttggagaataatggatgcgctcgcgatcagggttgcgagatcccagtctttagagacggtgttgtctttgagtccgcctagcaggtcaataatggattgtttgatgtcgtctgtggtgtctccgcggatgaccgcccacggggctgcatagtcgccgccgtatttgagtgtgacggtgatacggtcatcaccactgctgttggtatcggtcactggttctcctcatctttctctgtcggtggtgtgatggtggtttggatcgggtacctgtaggcgtctttcccgttgacggcccagcatgcgtcccgtacggggcatcctttacacattgtggtgacatgggggacgaagatgccttcgctgattcctttcattgcttgactgtacatggatgatacatgccggtaggtgttgttgtcaagatcgtacagttcggtggctgtgccctcggttggcgatgtggtgttagtgcggctgatggcgggggtccaaaacatgcctttcgtcacctggatgccattctgggcgagcatgtaccggtaggtatgcaactgcatagcatcaaccggcagtcgaccggttttgaggtcgaggatgaatgtttcgccggtgttggtgtcggtgaagacacggtcgatgtagccaacaatcttggtgccgtcctggagtgtggtttcgactggatattcgatgcctggctggccgtccaaaaccgcggtgtggtattgtggatggtttgtgcgccactgtttccacctgtcgacgaagatggggccatagtgcatccaccagtcgtagtcttttttgttggggcctccggtttcgcacatgtttttgcacactctgccggagggtttgatttgggtaccctcttctttgactagggcgatttgggtgtcgaaaacattgttgaaggatgagagtttatcgggtatttcggggtattctgcgggattgtacaggtggaggtcgtattgttcggtgatgtggtgtatagcactgccggcgatggtggcgtaccaggtgtggtgttgtgcatggtagccgtgggataggcgccatttttctccgcattcggcccactgggacagggaactgtaggagatgtggcctggatggttgatgattttcgggtgttgtgctagaggcatgttagttgtttttgttccatgggttgcgggtgtctaatccggcgtcatgctgctggtaggcgaggagtgcgaggcagtgccaggcagcgtgtgccaggtggggtagccctgattcatcgtcgaggttgtgtccttgctgccaggctagcaggtgcctatagagggcgtcaacactgtggctccacgggtatcctccggtccagttgttgtcgccgtatttggtggcgccgtatccggctacttcgccgagcgagtggagggatgcggggtcgatgagggagagcctgcacagtttcaattcttttcgggctccggtgttggggtcggtgtacatgctggtgggctggtccatggggtgtgtgctccttaaaggtgggttactggttgttgttgtgggcgagtgcgacggcgagaataatgatggcgagggtttcagcaataagtatgggtgttgtgatcatttggtgttgtggggattgtaggtgagggttgatgcacctagaagcgatgcgagggcgcatgcggcgatgatggcgagggcggctttgtggctggtgccggtggcgtacatccatgtgatgatgccgccttggatccaggcgaggctggtgaagaatgtttcgtaactgtgcaactcgatgttgttgggtgtgttcatgactgttcctggatgatggtgttgatggttttgtagatgttgtacaggtcggtttcgatggtttgtagctgtttgatttggtggtcgaggttgatgtctgggttgagggtgttgatgcgggatgcgatgtcggtggctgtgcggagtgtgccgccagtgtggtgaatgatatgtgcggtgtcggcgaggccggtggtgacagcatagtgggagaggagaggcatagcggtccttggcgggttagtgttgcgggttgatgttgaggtcggtgacgtggggtgtgttttctgttccggtgacgaggcagtgaacagtgacagggagtttggaggctcccggctgacggatggtggcgccgtagacgatgctgaatgtgtctttgtcaatgattttgtggagttggaggtcgatgtcggggttgccgttccatttgacgccttgggcggcggcctgctgttcggctttgcggttgcaggtgtgggctgcggtgatcatggtgagaccctgcgctgtttcttctccgcgctgctgtgcttgctggtgtacctttttttgttcggcttgtagggagcggactgctgcggccttcctggctgtcttctcagctttgcgctgctggacggtttcgggcgtccattcggtgttggctgtggtggcttgtggtgcgggctgtgaggcgagtggcgggttgtcgtcgggtgctggcatgaatgatgctgcggcgatgatggcggctgtgattccggcgatggtgtagcctgttttcttgttcatggctctgtgttcccctttcgtggggtttgttcgttgctgacatgattaatcatggtgtgggcggtggcctgtgtcaaggctgcgctcaacgattgtgagcgatccttgtgtggctaggggttttatcgggcgcacagggtgagtaggtggccaacgttgatgcgggtcacattccagtagagttgcgtggcttcaccgccggtgagcggcttccactcgtcatggctgaacacggcgccgtcggatgcgatgaatgtgttggggcgtagtttgtggagttcggcttccacgctctgccggtaggcttcggcgaggccctcaaaatcgaggtggtcgcaggagaggttttcgaagcgtgtcaagtcgaagggtatggggcagtcgtagctggtgggggtgtagagctgggtgaagtggtcggcgatcttatgcataacgggttccttttctggtgatggtgtgttgagggtttatcgggtggatgctttgaggattgcgtctatgtcgatcatgtcgatgagatcgtggagttcctcggcttcattctcggtgagcggctgccagtcgggtggcccgtatagggcgccgtcgcgggtgacagtccacaggggccggatgagtagtatggcttcttgtactttagcgtggtacatgcggcgcaccatatcgagatccatgtcgtctgaatggtctccggtgaggctgtggaggctgagcgggtcgatttcggtctgcctgtagagggatgtgaaggatggggtgatgagtgtgccatccatgggtgtgctcctttcggtggtgtaggggttgttgtggtttctagggtgtgatggctgcgaccctacagtcaaggctgcgctcactaggtttgagcgtttcatgctggagtgtcgggtgtgacagatgtcactgcagtctctatggcctctctcagcgtctcaaatcatgtgggggtaggattatatagggttggccctgctgatcgattctagggcccttctagggtgtctcgggggtatgtctgggtgatagcaggtgttgcagatcattcggaaggtcgaggttggcatacatcacgatagctggggtgctatttctgggcatggaatctacaccctcatactgtgtgagatgtatcacatcctcctggcttggtgtgcaccctcaggatcactctgccgatctggcgtgaagggtgtagcccagaaatgccgtttaaagccttcacacgacgcctaggagcgccttacagggtgggggctaggtatttatacccccagcatattctgatcgattctagacgcctccaggagtctgctacgcgatcaaccatctcggcatagaccatcaacccttacatcagttagctaagcctcaactatgtggacagtgtgggatactgtagggggaagaaggacacggtaaaagaaagaagggggagcatcagccttaggatcttagcactgatggacttagcaccgagcccctcaagggctcggcatcagcctcatcgggcttagccgatcaggcacagacctgaaaggagtacacgccatcaggaaaggcttgagagtacgaggagccttagcgacgagtactcgaaagcctgagggaacacccatcagcactgatgggcctagcgtgttcggaaaggacacaagagtgaagtgtgagagctgtccgggagtgaaacccgttctgactaggggtttcagccttaaccacccccaaaggttacaagactctaagaaaatttaaggaaaagtttaggtttaatttttggacctttactaccaaaaacacccgtttacacccctcaaacccgcctatagagccaaacgctggtgttgagggtatctctacctagtgtgataggctggacaggtagccagctggacgcaaggccgaaatccgctgacgcggctttcacccttacatccatcagtctaccaaacacttaaaagcttcaaggcttagcgctaagcccttaagaccttaacgcttagcaccgagcccctcaagggctcggcatcagtcttaaagccttaaacacttaaagtaactataagaccttaaagaccttaagtacttaaagttaaccatcagtcttaaactttaatattatacctataagtcttaaagcttataggtataataatataatataagttataaaagttttagaagagctaaggggttaacttctttacttctctactctctttggttctttctctcttctcttcttttcttcatcaggggagaagaggaacctttaccgtcaacgctgattggctttcaccgtgtgactcgtgtaccaccggtcgcacgctccccacactctgacacccgtgtccctttcatgcttagcgtgttcggctgaaggcgtacggcgtgtcacgctaacacccttaacactaggtaagacttaaagtgtatattataggtagaagactttaaaaacctctaaggtgttcccgcttagcctgtgttctacaccgctaggcgccaagtgctaagctttgaaacgcgaacactcacccaccctcatttttctttcgtgtccttctcttttgacaccgctggggggcgatgtgatctttctcacatgccagggggtgtgagggaaaacaaccaccccggaacgttcaagacaccccctcaaagccacaaaacagcccccagaatcgactagcagggcaagggcagagtattcatacccccaacggtttccaggccgttagaggggcaaataagacccgtacagggctagacgaggaacagacacatcatggcacgaaccaaccgcacagccagccaagcccaccggcgctggcggcaacgactcatcacccaagcccgacagcaaggccaaaccgtctgcccactctgcggagtcaccatcacctgggacacccaccagctgccaaccagccccgaagccgaccacatcacacccgtcagcaggggaggactcaacaccctcgacaatgggcaaatcatctgcagaacatgcaacagaagcaaaggcaacagaacacaaccaaacattcaattccaacaacaaaccacaaaaacacttgtttcatggtgaaaaacccgccaacccccaccggggacaccccctgcacaggcgtgcaagacc

SEQ ID NO: 36 - DNA, 29200 bp, Unknown
  source: /note="Description of Unknown: Bacteriophage of P. acnes"
agtgaaatacctcccttttgtggttttgtctgtttgtcgactttttgtgttggtggtgagtgttgtgcagcctgagcttcctgatagtcgtgattggtgtggggagacgcgtcgttggtggcgtgtgtggggtgaggatagccgcgcgcagtacgtgtctgatgaggagtggctgtttctcatggatgctgcggtgattcatgattgtgtgtggcgtgagggtcgcgcggatttggtggcttcgcttcgtgctcatgtgaaggcgtttatgggtatgttggatcgttattcggttgatgtggcgtctggtggccgtggtgggggttctgcggtggcgatgattgaccggtataggaagcgcaagggggcttgagtaggtgtctggtgttgttgggtctcaggttcctcgtcatcgtgtggctgcggcgtattcggtgtctgctggcggggatgctggtgagttgggtcgtgcgtatgggttgacgcctgatccgtggcagcagcaggtgttggatgattggctggctgtcggtagcaatggcaggcttgcttcgggtgtgtgtggggtgtttgtgcctcgccagaatggcaagaatgctattttggagattgtggagttgtttaaggcgactattcagggtcgccgtattttgcatacggctcacgagttgaagtcggctcgtaaggcgtttatgcggttgcggtcgttttttgagaatgagcggcagtttcctgatttgtatcgtatggtgaagtcgattcgggcgacgaatggccaggaggctattgtgttgcatcatccggattgtgccacgtttgagaagaagtgtggttgtcagggttggggttctgtcgagtttgtggctcgtagccggggttctgctcgcgggtttacggttgatgatttggtgtgtgatgaggctcaggagttgtcggatgagcagttggaggctttgcttcctacagtaagtgctgccccgtctggtgattcgcagcagattttccttggtaccccgcctgggccgttggctgatgggtctgtggtgttgcgtttgcgtgggcaggcgcttggtggtggtaaaaggtttgcgtggacggagttttcgattcctgacgagtctgatccggatgatgtgtcgcggcagtggcggaagttggctggtgacactaatccggcgttgggtcgtcgtctgaattttgggacagtctcggatgagcatgagtcgatgtctgctgccgggtttgctcgggagcgtcttggctggtgggatcgtggccagtctgctgcgtctgtgattcctgctgataagtgggttcagtcggctgtggatgaggcggctctggttggcgggaaggtttttggtgtctcgttttctcgttctggggatcgtgtcgcgttggctggtgctggccggactgatgctggtgttcatgttgaggttattgatgggctgtcgggaacgattgttgatggtgtgggccggttggctgactggttggcgttgcgttggggtgacactgaaaagatcatggttgccggatctggtgcggtgttgttgcagaaggcgttgacggatcgtggtgttccgggccgtggcgtgattgtggctgatactggggtgtatgtggaggcgtgtcaggcgttcctggagggtgtcaggtctgggagtgtttctcaccctagggctgattctcgccgtgacatgttggatattgctgtgaggtcggctgtgcagaagaagaagggttctgcgtggggttggggttcctcgtttaaggatggttctgaggttcctttggaggctgtgtctttggcgtatcttggtgcgaagatggcgaaagtgaagcggcgtgaacggtctggtaggaagcgggtgtctgtggtatgaactcggatgagttggctttgattgagggcatgtacgatcgtatccaaaggttgtcttcgtggcattgccgtattgagggctactatgagggttctagtcgggtgcgtgatttgggggtggctattcctccggagttgcagcgtgtgcagactgtggtgtcgtggcctggtattgctgtggatgctttggaggagcgtctggattggcttggctggacgaatggtgacggctacggtctggatggtgtgtatgctgcgaatcggcttgctacggcgtcgtgtgatgttcatttggatgcgctgatttttggtttgtcgtttgtggctgttattccccagggggatgggtcggtgttggttcgtcctcagtcaccgaagaattgtactggccggttttctgtcgatgggtctcgtttggatgctggccttgtggtgcagcagacgtgtgatcctgaggttgttgaggcggagttgttgctgcctgatgtgattgttcaggtggagcggcgtgggtctcgtgagtgggcggagacgggccgtatcgtgaatgtgttgggtgcggttccgttggtgcctgttgtgaatcgtcgccgtacttctaggattgatggccgttcggagattacgaggtctattagggcttacacggatgaggctgttcgcacactgttggggcagtctgtgaatcgtgacttctatgcctacccgcaaaggtgggtgacgggtgtgtcggctgacgagttttcgcaaccgggttgggtcttgtcgatggcttctgtgtgggctgttgataaggatgatgatggtgacactccgaatgtggggtcgtttcctgtgaattctcctacaccgtattcggatcagatgcgtttgttggcgcagttgactgcgggtgaggcggctgttcctgaacgctatttcgggtttatcacgtctaacccgccttctggggaggctttggctgcggaggagtctcggcttgtgaagcgtgctgaacgccggcagacgtcgtttggtcagggctggctgtcggttggtttcctggctgccagggcgcttgattcgagtgttgatgaggccgcgtttttcggtgatgttggtttgcgttggcgtgatgcttcgacgccgactcgggcggctacggcggatgctgtgacgaagcttgtgggtgccggtattcttccggcggattctcggacggtgttggagatgttgggtttggatgatgtgcaggttgaggctgtgatgcgtcatcgtgccgagtcttcggatccgttggcggcgctggctggggctatttctcgtcaaactaacgaggtttgataggcgatggcttcgggtgctatgtcgaggttggctgctgccgggtatcagcgtgaggcggtcaggtttgctgggaagtatgcgggctattatgccgagttgggtcgtttgtggcattccgggaagatgacagatgcgcagtatgtgcgtttgtgtgtggagttggagcgtgccggccatgacggttcagcagctatggctgctaagttcgtgcaagattttcgccggttgaacggcgtcgatcctggtttgatcgtgtatgacgagtttgatgctgctgcggctttggctaggtcgttttcgactatgaagattatgaatagtgacccggatagggcgaatgatactattgatgctatggcggcgggtgttaatcgtgctgtcatgaatgctggccgtgacacggttgagtggtctgctggtgcgcagggtaggtcgtggcgtcgggtgactgatggtgatccgtgtgctttttgtgccatgttggctacgaggtcggattatacgactaaggaaagggcacttactactggtcatacgcggcgtcataagcgtggtggtaagcgtccgtttggttcgaagtatcatgatcattgtggttgtacggtggttgaggttgttggcccttgggaaccaaatagggctgatgccgagtatcagaggacgtatgagaaggcccgtgagtgggttgatgatcatgggttgcagcagtcgcctggcaatattttgaaggctatgcgtactgttggtggcatgagataatttgatgtggtttccggttgtgcgctgccggttattggtgcacagggttgtctcccgcacgggggtcaacaatgttgtgttgttttccgcaaggagtgtagggttaggctatggccgatcaaaaagttgaagaacagaatgttgacaatgatgttgtggagtccggaaaggataacggcattgttgatacagtaaaagacgatggcgggcgggaggtagccgacaatcagttgaagaatgaaggcgagggtaaatcgccggggactgattggaaggcggaggcccgtaagtgggagtctcgtgctaaaagtaatttcgccgagttggagaagcttcgtacatcgagtgacgattctgggtctactattgatgagcttcgccgcaagaatgaggaactcgaagacaggattaacgggtttgttcttgagggtgtgaagcgcgaggtggcttcagagtatggtttgtccagtgatgcgatcgctttcttatcgggtggcgataaggagtcgcttgccgagtctgcgaaagctttgaagggtttgatcgaccatagtagtggtggcgcgggtgtgcgccgtcttgcggggagtgcccccgttgatgatgttaaacgacgtgagggtgtcgcgtttgtggatgctcttgtcaataattctaggagatgatttgtgatggctgacgattttctttctgcagggaagcttgagcttcctggttctatgattggtgcggttcgtgaccgtgctatcgattctggtgttttggcgaagctttcgccggagcagccgactatttttggccctgttaagggtgccgtgtttagcggtgttcctcgcgctaagattgttggtgagggcgaggttaagccttccgcgtctgttgatgtttcggcgtttactgcgcagcctatcaaggttgtgactcagcagcgtgtctcggacgagtttatgtgggctgacgctgattaccgtctgggtgtgcttcaggatctgatttcccctgccctgggtgcttcgattggtcgcgccgtggatctgattgctttccatggtgttgatccggctacgggtaagcctgctgcggctgtcaaggtgtcgctggataagacgaagcatattgttgatgccacggattccgctacggctgatctggtcaaggctgtcggccttatcgctggggccggtttgcaggttcctaacggtgttgctttggatccggcgttctcgtttgccctgtctactgaggtgtatccgaaggggtctccgcttgccggtcagcctatgtatcctgccgccgggtttgctggtttggataattggcgtgggctgaatgttggtgcttcttcgactgtttcgggtgccccggagatgtcgcctgcctctggtgttaaggctattgttggcgatttctctcgtgttcattggggtttccagcgtaacttcccgatcgaactgatcgagtatggcgatccggatcagactgggcgtgacctgaagggccataatgaggttatggttcgcgccgaggctgtgctgtatgtggctatcgagtcgcttgattcgtttgctgttgtgaaggagaaggctgccccgaagcctaatccgccggccgagaactgatttattgttgcggtgatgtgtcaatgtgcagggggtggtgttgatgggtatcattttgaagcctgaggatattgagcctttcgccgatattcctagagagaagcttgaggcgatgattgccgatgtggaggctgtggccgtcagtgtcgccccctgtatcgctaaaccggatttcaaatacaaggatgccgctaaggctattctgcgcagggctttgttgcgctggaatgatactggcgtgtcgggtcaggtgcagtatgagtctgcgggtcctttcgctcagactacacggtctaatactcccacgaatttgttgtggccttctgagattgccgcgttgaagaagctgtgtgagggtgatggtggggctggtaaagcgttcactattacaccgaccatgaggagtagtgtgaatcattctgaggtgtgttccacggtgtggggtgagggttgctcgtgcgggtcgaatattaacggctacgctggccccttgtgggagatatgatatgaccagttttccttacggtgaaacggttgtgatgcttcaaccgactgttcgtgtcgatgatcttggtgacaaggttgaggattgggggcatcctgtagaaaccgtgttccataacgtggccatctatgcttccgtttcgcaggaggatgaggctgcggggcgtgactcggattatgagcattggtcgatgcttttcaagtcccctgttgtgggtgccggttatcgttgccggtggcgtatccggggtgttgtgtgggaggctgacgggtctcctatcgtgtggcatcaccccatgtccggttgggatgcgggcacgcagatcaatgtgaagcgcaagaagggctgatgggtagtggctcaggatgtgaatgtgaagttgaacttgccgggtattcgtgaggtgttgaagtcttctggggtgcagggcatgttggctgagcgtggcgagcgtgtcaagcgtgcggcctcggcgaatgtgggcggtaacgctttcgatagggcccaataccgtaatggtttgtcgtcggaggtgcaggttcaccgtgttgaggctgtggcccgtattggcaccacctataagggtggtaagcgtattgaggcgaagcatggcacgttggcgaggtcgattggggctgcgtcgtgatcgtttatggtgatccgcgtgtgtgggctaaacgcgtgctcaaggatgatggctggctgtctgatataccttgtgtggggacggtgcctgaggatttcagcggtgacttgatttggttggcgttggatggtggcccacagttgcatgttcgtgagcgcgtgtttttgcgggtgaatgtgttttctgatatgccggatcgtgctatgtctttggcgcgtcgtgttgaggccgtccttgttgacggggttgatggtgacccggtggtgttttgtcggcgttctactggccctgatttgctggttgatggtgcacgttttgatgtgtattcgctttttgagctggtgtgccggcctgtcgaatccgagtaagcgtatcgttgtttttttagtttgattgttttttagtttgattgttttttgggggttatgatggctggaacacgtacagcgtctaatgttcgctctgctgttacgggtgacgtctatattggtaaagctcatgccggtgatactattaagggtgttgaggctgttccttccgggcttacagctttagggtatctgtctgatgacgggtttaagattaagcctgagcgtaaaacggatgatttgaaggcttggcagaatgcggatgttgttcgcacggttgctaccgagtcttctatcgagatttctttccagctgatcgagtctaagaaggaggttatcgagctgttttggcagtcgaaggttactgccggatccgattcgggttcgttcgatatttctccgggtgccacgacgggtgttcacgccctgttgatggatattgtggatggcgatcaggttattcgctactatttccctgaggttgagcttatcgatcgtgacgagatcaagggtaagaatggcgaagtgtacgggtatggtgtgacgttgaaggcttatcctgcccagattaataatactggtaatgctgtgtctggtcgggggtggatgacggctttaaaagctgatactcctccgactcctccgccggccccggttcctccgaagcctcagccggatccgaatccgccgtctgagaactgatacacgattttagggattgttgatagatgagtgacacaggttacacgttgaagattggtgaccgtagctgggtgttggcggatgcggaggagacggctcaggctgttcctgcccgcgttttccgtcgtgcagctaagattgcccagtcgggggagtctgcggatttcgcccaggttgaggtgatgttttctatgttggaggctgccgccccggctgacgcggtggaggccctggaggggcttcctatggttcgtgttgccgagattttccgccagtggatggaatacaagcctgacagtaagggtgcctcgctgggggaatagtttggctccacggcctgattgatgattatcgtggggccatcgaatacgatttccgcactaaatttggtgtttctgtttatagtgttggtggcccgcagatgtgttggggtgaggctgtccggctggctggcgtgttgtgtaccgatacgtctagccagttggcggcccacctgaatggttggcagcgcccgtttgagtggtgcgagtgggctgtgctggacatgttggatcattacaggtctgctaatagtgaggggcagccggagcctgtggcgaggccgacggatgagcgtagggcccggtttacgtctgggcaggtggacgatattttggcgcgtgttcgtgccggtggcggggtgtctcgcgagattaatattatggggtgaatagtgtatgtctggtgagattgcttccgcatatgtgtcgttgtatacgaagatgcctggtttgaaggcggatgttggtaaacagctttctggggtgatgcctgctgagggtcagcgttcgggtagtctttttgctaagggcatgaagttggcgcttggtggtgcggcgatgatgggtgccattaatgttgctaagaagggcctcaagtctatctatgatgtgactattggtggcggtattgctagggctatggctattgatgaggctcaggctaagttgactggtttgggtcacacgtcgtctgacacgtcttcgattatgaattcggctattgaggctgtgactggtacgtcgtatgcgttgggggatgcggcgtctacggctgcggcgttatctgcttcgggtgtgaagtctggcgggcagatgacggatgtgttgaagactgtcgccgatgtgtcttatatttcgggtaagtcgtttcaggatacgggcgctatttttacgtctgtgatggctcgcggtaagttgcagggcgatgacatgttgcagcttacgatggcgggtgttcctgtactgtctttgcttgccaggcagactggtaaaacctcggctgaggtgtcgcagatggtgtcgaaggggcagattgattttaacacgtttgcggctgcgatgaagcttggcatgggtggtgctgcgcaggcgtctggtaagacgtttgagggcgctatgaagaatgttaagggcgctttgggctatctgggtgctacggctatggccccgtttcttaacgggttgcggcagatttttgttgcgttgaatccggttatcaagtctatcacggattccgtgaagccgatgtttgctgccgtcgatgctggtattcagcgtatgatgccgtctattttggcgtggattaaccgtatgccgggcatgatcactcgaatgaatgcacagatgcgcgccaaggtggagcagttgaagggcgtttttgcgaggttgcatttgcctgttcctaaagtgaatttgggtgccatgtttgctggcggcaccgcagtgttcggtattgttgctgcgggtgttgggaagcttgttgcggggtttgccccgttggcggtgtcgttgaagaatttgttgccgtcgtttggtgctttgaggggtgccgccggggggcttggtggcgtgtttcgcgccttgggtggccctgttggtattgtgatcggcttgtttgctgccatgtttgctacgaacgcccagttccgtgccgctgtgatgcagcttgtgggtgttgttggccgggctttggggcagatcatggtcgctattcagccactgttcgggattgttgctggcgtggttgccaggttggcgccagtgttcggccagattatcggtatggttgctggtttggctgcccggctggtgcctgttattggtatgcttattgcccggctggttcctgttatcacccagattattggtatggtaacccaggttgctgccatgttgttgcctatgctgatgccggttattcaggctgttgttgctgtgatacggcaggttattggtgtcattatgcagttgatacctgttttgatgccggttgtgcagcagattttgggtgctgtcatgtctgttttgccgccgattgttggtttgatacggtcgctgataccggtgatcatgtcgattatgcgtgtggtggtgcaggttgttggtgccgtgctacaggtggtggcccgtattattccggttgttatgccgatttatgtttcggtgattggattcattgccaagatttatgctgcggttatcgtttttgaggctaaggttattggcgctattcttcgtactattacgtggattgtgaatcattcagtgtctggcgtgaggtctatgggcacggccatccagaatggctggaatcatatcaaatcgtttacgtctgcgtttattaacggttttaagtcgatcatttctgccggtgttgccgcggttgtggggttttttacgcggcttggtttgtcggttgcttcccatgtgaggtctggttttaacgcggcccgtggcgctgtttcttctgcgatgaatgctatccggagtgttgtgtcttcggtggcgtctgctgttggcgggtttttcagttcgatggcgtctaaggttcgtagtggtgctgtgcgtgggtttaatggtgcccggagtgcggcttcttctgctatgcatgctatggggtccgcggtgtctaacggcgtgcatagtgtgctgggttttttccggaatctgcctggcaatattcggcgtgctctcggtaatatggggtccttgttggtgtctgctggccgtgatgtggtggccggtttgggtaacggtattaagaatgctttgagtggcctgctggatacggtgcgtaatatgggttctcagattgcgaacgccgcgaagtctgctttgggtattcattccccgtccagggtgtttcgtgaccaggttggccgccaggttgttgccggtttggctgaggggatcaccggtaatgctggtttggcgttggatgcgatgtcgggtgtggctggccggcttccggatgctgtggatgcccggtttggtgtgcgatcgtcggtgggctcgtttaccccgtacgaccggtatcggcgtgcgagcgagaagagtgttgtggtgaatgttaacggacccacgtatggtgatcctaacgagtttgcgaagcggattgagcgtcagcagcgtgacgctttgaacgctttggcttacgtgtgattgggggtgtggttcatgtttcttcctgacccgtctgatcgttctggtttgactgttacctggtctatggatccgctgtttggcgatgaacgtgtgcttcatttgacggattatacggggtcgtctccggtgatgttgttgaatgattcgttgcgcggtttgggtgttcctgaggtggagcatttttctcaaactcatgttggggtgcacggttcggagtggcgcgggtttaatgtgaagcctcgcgaggtgacgctgccggtgcttgtttcgggtgttggtgtggatcctgtgggcaggtttcgtgacggtttcatgaaagcctatgacgcgttgtggtctgcttttccccagggcgaggagggggagttgtcggtgaagaccccgtctggtcgtgagcgtgtgctaaaatgccggtttgattcggctgatgacacgtttacggtggatccggtgaacaggggttatgcgcgttatctgttgcatttgacggcttatgacccgttttggtatggggatgagcagaagtttcgttttagtaacgcgaagttgcaggattggttgggtggcggccctgtcggcaaggatggtacggcgtttcctgtggtgttgacgcctggtgttggttcgggttgggataacctgtctaataagggtgatgtgcctgcgtggcctgtgattcgtgtcgagggcccgttggagtcgtggtctgtgcagattgatggtttgcgtgtgtcttcggattatcctgtcgagaagtttgattggatcactattgatacggatcctcgtaagcagtctgcgttgttgaatgggtttgaggatgtgatggatcgtttgaaggagtgggagtttgcgcctatcccgcctggcggttctaagagtgtgaatattgagatggttggtttgggtgccattgttgtgtcggtgcagtacaggtttttgagggcttggtgaatagttgatggctggtcttgttccgcatgtaacattgtttacgccggattatcgtcgtgtggcgcctatcaatttttttgagtcgttgaagttgtcgttgaagtggaatggtttgtctacgctggagttggtggtgtcgggggatcattccaggcttgacgggttgactaggccgggtgcacggctggttgttgattatggtggtggccagattttttctgggcctgtgcgtcgggtgcatggtgtgggtccgtggcgttcttcgcgggtgactatcacgtgtgaggatgatatccgcctgttgtggcgtatgctgatgtggcctgtgaattatcgtcctggtatggttggtatggagtggcgtgcagacagggattatgctcactattcgggtgcggctgagtcggttgctaagcaggtgttgggggataatgcttggcgttttccacctggtttgtttatgaccgatgatgagcgtcgtggccgctatattaaggattttcaggtgcggtttcacgtgtttgccgataagttgttgccggtgttgtcgtgggctcggatgactgtcacggtgaaccagtttgagaatgcgaagtttgatcagcggggtttgctgtttgattgtgtgcctgctgtgacacggaaacatgtgttgactgccgagtctggttcgattgtgtcgtgggagtatgtgcgtgacgccccgaaggcgacatctgtggtggttggtggccgcggcgagggtaaggatcggctgttttgcgaggatgttgattcgatggccgaggatgactggtttgatcgtgtcgaggtgtttaaggatgcccgtaacacggattctgaacatgtgcatctcatcgatgaggctgagcaggtgctgtccgagttaggggccacgtcggggtttaagatcgagttggctgagtcggatgtgttgcggtttgggccaggcaatctgatgcccggggatttgatctatgtggatgtgggttctggccctattgcggagattgttcggcagattgatgtggagtgtgattcgcctggtgatggttggacgaaggtgacaccggttgcgggggattatgaggataatccgtcggccctgttggctcgccgtgtggctggtttggctgcgggtgtgcgggatttgcaaaagttttagtaagtgattggggtttgttgtgggtattgtgtgtaaagggtttgatggtgtgttgaccgagtatgattgggctcaaatgtctggtctgatgggtaatatgccgtctgttaagggcccggacgattttcgtgtcggtacgacgattcagggtgccacagtgttgtgtgaggtcatgccggggcaggcttgggctcacggggtgatgtgcacgtcgaatagtgttgagacggtgacggggcagcttccgggcccgggtgagacccgatacgactatgtggtgttgtctcgggattgggaggcgaacacagccaagttggagattgttcctggggggcgtgcggagcgtgccagggatgtgttgagggctgagcctggcgtgtatcatcagcagttgttggctactttggtgttgtcgtctaacgggttgcagcagcagttggatcggcgtgctatagcggcccgtgtagcgtttggggagtctgcggcttgtgatcctacccctgtggagggtgaccgggtgatggttccttcgggggctgtgtgggctaatcatgccggcgagtggatgttgttgtctccgcggatcgagacgggttcgaagtcgatcatgtttggcgggtctgctgtgtatgcttacacgatcccgtttgagcgccagttcagtagtccgcctgtggtggtggcgtctatggctacggcggctgggggcacgcagcagattgatgtgaaagcctacaatgttactgccaaggattttggtttggcgtttatcacgaatgacgggtctaaaccgaatgatgtgcctgcggttgcgaattggattgctgtcggcgtgtaatgcgcggcttgcgggtatgtgacatgttgtggtggttgtagtggtagggggctgtagtgtcatggcttacacccacactcgtagcctctatttgtaccgctatcgctactgtccttggttcgattcaggcggctacgtacaggtcgaagaagaggcttaggcagttgtctgcgcaggttgatgcgatggaagaatacacgtggaatattcgccatattgttcatcgctataacgcgaatctaccggagaatgttgagcctgtaaagatgcctgatttgcccgagtttttgaaggatactgttgatggtggtggggggtgaattgtgagggagttggaggaagagaagcggcagcgccgctcgtttgagaaggcttccctgatactgttgttcctgtcgcttgtgctgttggcggtggttgctgggggtgctttacgtttcggtgctgtggcttcccagcgggattcggagcaggctaaagcccagtcgaatggtacagccgctaaagggttggccagccgtgtgcggcaggtgtgtgcctctggcgggcaggagtcggtgcgtcttcaccggtctggcttgtgtgtggatgctcagcgtgttgagcgtagcgtgcagggtgtgccgggtcctgctggtgtgcgcggcccgcaagggcctgcaggggttgacggccgggatggtgttaatggttcagctgggctggttggccctgttggtccgcagggttccccgggtttgaatggtgtgaagggtcctgacgggctgcccggtgctaacggcaaggatggtgttgccggtgtgaacggggctgatggccgggatggcgtgccaggtagggatggcgctgatggggctgatggtggccgtggccctgttggtccccctggtgtagccggtgcacagggtgagcgtggccctgttgggcctcaggggccgcagggttctgccggtgccgatggcaaggacggtaaagatggtaaggatgggcgctcggtggtgtctgtgtactgttccgggggccgcctggttgtgaaatatagtgacggtacggcctctaccatagcgggttcggtggcctgccagggtgtgaaaccatcaccggtggttaccgtatcatcccacaagtaaaagaggaagggtgttactagtgttgatagtagtgtttgggggtggcgtgttgtgagatacattccagcggcgcatcactctgccggatcaaataagccggtgaaccgtgttgtgattcacgcgacatgcccggatgtggggtttccgtctgcttcccgtaatgggcgggcggtgtccacggcgaactattttgcttccccatcgtcgggtggttctgcccattatgtgtgtgatattggggagacggtgcagtgcttgtcggagtcgactattggttggcatgccccgccgaatccgcatagtttgggtatcgagatttgcgcggatgggggttcgcacgcctcgtttcgggtgccggggcatgcttacacgagggagcagtggctggatcctcgcgtgtggcccgccgtggagagggcggctgtcctgtgtcggcagttgtgtgacaagcatggtgttccgaaaaggaagcttagtgcagccgatttgaaggctggcaggcggggcgtgtgcggtcatgtggatgttactgatgcgtggcatcagtcggatcatgacgatccggggccgtggtttccgtgggacaggtttatggccgttgtcaacggcggtagtggtagtgaggagttaactgtggctgatgtgaaagccttgcatgatcagattaaacaattgtctgctcagcttactggttcggtgaataagctgcaccatgatgttggtgtggttcaactacagaatggtgatttgggtaagcgtgttgacgccttgtcgtgggtgaagaatccggtgacggggaagctgtggcgcactaaggatgctttgtggagtgtctggtattacgtgctggagtgtcgtagccgcatcagtaggcttgagtcgactgtcaacggtttgaaaaagtgatggtggtttgttgtgggtaaacagttttggttgggcttgtttgagcgtgccctgaaaacttttattcaaacgtttgttgctgtgttgggtgtgacggcgggtgtcacgtatactgcggagtcgtttcgcggtttgccgtgggagtctgccctgattacggccacggttgctgcggtgctgtcggttgctacctcgtttggtaatccgtcgtttgtggccggtaagcctaaaaccacggttgtggatgctgggcttgttccacccgacgatgggggcatggttgagccgcacatggttgatgtgtcggatcctggcatgatcgagcctgtcgatgatgcggatgttgccggctatgagcctcggcgtgcagccgagtcggaggttggcacggtagagcctgattgaatgataagtgaatatgtgtgtgccccagcggtgctgccacgatcgtgtggtggttgccgctggggcactatttttgtgtctacaggggttttacaggttgtcgtctagtgtgtcttcgagcatctggtccaggtggaggcaggcggagatagtatcgttggcctggtctagaacgttccggccgataacatttttgtggttgtcgcggtgactgatgatagactgcatgatatcttcggcctccacgtgcagtagtttggtttggtatgcgattccggcgagccagtctagtgcttcctggcttgcataggggctctggtcctcgctgttgtcacgggtgttgctgttgtttgggtgtcctgcactgtcgcaaaaccacaagatttcgctgcactcgtctagcgtgtcctggtcgatagtgagatcgtcgaggctgacttcgttaacagtaaggttcacattgtcgagtgagatgggtacaccgtactggttttcgacaccgccaacaatgttttccaattgctgcatgttggtgggctgttgttggatgattcggtgtaccgctgctttgagggcagtgtgggggatattggttgtgttgttcatcgtgttatgccattccttcattatcgtctggcatgtagtatgtgctgtttgcgtactcggttaacgtcatcagtgtttggtctgcccactgtttcacggtttgtcgggtgactccgagccggtgcgccgcggcggagtatgtttggtcatacccgtatacttcacggaatgctgccaacctggctagccgtttcctctgtttggatggctggcaggtgagggtgtagtcgtcgatggctagctgtagatcgatcatggtgacgatgttgttgccgtggtgttgtggcgcggttggtgggggtggcatgcccggctccacactgggtttccatgggccgccgttccagatccattgtgctgcttggatgatttctgcggtggtgtaggttcggctcactggtcatcccctgaataggttgtcgaggttgtctgggttgctggtgttggtggtgtcgaatcgtcccacgcagtggcagtagtcgtacatgagtttgataatgtgttggtggtcgccgaggtaggtgtttccgctgatgctgtaggtggctgtgccgtcttttgcgatggtgtatttggcggtgatggtttcgggtgtttcggtgttggtgatgattgctgtggtggtggtgcctacggtttggagtatggtggtttgggttccgtcgtcgaggatggttttaaccatggtgtgtgttctccctttgtgttagttgcttgtctggttgtcggctagatgaataatatcggataaaggtttcggctggtctaggtgttgtatggttttgttggctagccgtttggctaccctgtagcacattttggtatagtgtttgttgtctaggttgtggtattgttcccgcaccgcaatatatagtagggagtcttggtacaggtcgtctgcgctgattgcggggtagtgtgtggctattttggtgcatgcccggttgagtgtgcgaagatgatggtctgtggcccatccccacgatgcggtggtggccaggtctgcttttgttggtcgtctgctcatggcactatttcatctcgctatctggtagttgtttggtgttttgttgtggatagtgtagcacactagtccggggtggccggtggtgcctgtgcggtgccggtaccagacggattcgccttccatggatgggcattggatgaaggtgcgttgtccttgctcggatatttctaggtggtgccggtgccctgccatgaggatgtgggatgtggtgccgttgtggaattcttggccgcgccaccattcgtactgtttgccggttttccattggtgcccgtgggcgtgcaggatttgtgtgccggccacttcaacggtggtggtcatttcgtctcggctggggaagtggaagtgaaggttggggtagttgttgttgagttggtaggcttctgcgatggcccggcagcagtccacgtcgaaggagtcgtcgtaggtggtgacgcctttaccaaatcgtactgcttcaccgtggttgccggggatggatgtgatggtgacgttggcgcagtggtcgaacatgtggacgagttgcatcatggccatgcgggtgagcctgatttgttcggtgaggggtgtttgtgtgcgccaggcgttgttgcctccttgtgacacgtatccttcgatcatgtcgccgaggaaggcgatgtggacccgttgcggtttgcctgcctgttgccagtagtgttttgcgactatgagggagtgcaaatagtcgtcggcgaagtgtgctgtttctccgccggggatgcctttgccgatttggaagtcgcctgccccgatgacgaaggccgcagtgctgtagtcggtgtgggtgtcttgttcgggttttggtggctgccattcggctagtttgttgacgagttcgtctacggggtaggggtttgttgcgggttggtggtcgatgattttttgtatggatcggcctgtttctccgttgggtaaggtccattcggagatgcgtgtgcggcgtacagtaccgttggctagattgtcgtcgatggtgtcgatggcgttgtcgtggttggctagctgtgtgagtagccggtctatattgtctatcactggttttcctcttctgtttgtggggtggtgttggcttgtttgcggcgatagtctttaatgacggtggcggagatggggtatccggcttcagtgagcatttgggctagctgtgtggcggggatggttttgtcggcgaggacgtctgcggctttgttgccgtagcgttggatgagggtttcagttttggttgccatgatgtcctaggggttgtgtggtgggctgccatcctgtgcggcagtcgccgtcgtgtcctggtttgcgtgtgcaccatgagacttcgccggcattgtggatgatggcacggccgcatatgacgtcatgtaggtgttcgggaaacttatcgttgttgttgtccccgtacatgtcgatcaagtgttgggttttagtaaccatcatgtctcctatgtgtgaaagagtgtgcaaatactatgcttgtgtcatggatgtttatgcgggtatggttttcatcaccttgctgaacgttacttggttactgtacatcatctgggtgatttcctgatccgttttgtcggggtgctgttttcgcaggtttgcccattggcaggcgttgtcggtttcttgctggagccgggtgagattgttttcggtgatgatttgtttccacattgtccacgagacgtcgagtcgtttgagcatgtcgagggctggcacgttgaactggtcgaggaagagtatttcctccgtgtagtactgtttttcgtattggtcccatccgcttcggtgtctgttgggctggtttttggggtaggcttcccggcatactttgtgcaaacgtttggccatgtctttgggtagcctaatgtcggggttggcgcggatcatggatcgcatcccatcataggtggtgccccaggtgtgcatgatgcggagtgggtcttcaccgtcggcccatttttctgcacagattgcgaggcggatgcgtctcctggcggctttgctggtgttgcgccggccggggatggggcacgtgtcgagggggtccatgatgttttctatgcctttcttggagtgatgttttgtttgtctggttttattgtagcactgtgtctagtgcttgtgtcaaccctgttttgcctgttttcaggtaggtgtctgtgacatccccgacagtgaggggtacgtgtatggcttgggggagtgccgtctggagggtttgggccatctggtctcctgctttgtcggggtcggaccagatgtagatgcggtcgtagccttcaaaaaatttggtccagaaagtttgccacgaggtggccccgggtagggctacggccgaccatccgcattgttcgaggatcatggagtcgaattcgccttcgcaaatgtgcatttcggctgcagggttggccatggcggccatgttgtagatggagcctgtgtcccctgccggggttagatatttggggtggttgtgggttttgcaatcatgctggagtgagcagcggaaacgcatttttcgtatttcggctggctccccccagacggggtacatgtaggggatggtgatgcactggttgtagtcttcgtggcctgggatggggtcattgtcgatgtatccaaggtggtggtagcgggctgtttcttcgctgatgcctcttgctgagagcaggtcgagtatgttttcgaggtgggtttcgtagagggccgaggctttctggattcggcggcgttccgcaatgttgtatgggcgtatactgtcgtacattcgggtttctttcttctaatcgttgttgtagctggttgagtccgcctccgacaccgcatgtgtggcagtaccagacgcccttgtcgaggttgatgctcatggagggctggtggtcgtcgtggagagggcagaggatgtgttgctcgttcctggacggattgtagcgtatgtggtagaggtcgaggaggcggcaggtgtcagaggtgtgggaggagctcgttgagggttgataccacataggcttcactccagggcttgttgcgctgttttatcactacgagtccgatggcggattggttttgtttgtttcggtgtgtttcgtagttgcgtgcctcccggctggcttgtttcacgaattcggcgaggtgtggctgcccggctttcgcctcgataatgtaggttttgtggccggttgtgaggatgaggtcgccttcgtcttcgcggccgttgaggtggaggcgttctatatcatggccggtgtcgcgtagctggtggaggagtcgtgtttcccattctgcgccggctcggcggttgcgtgactgttgtgttgacatgatagtcctttgtggtgttcggtcatgttccatggctgtttttcggcgagtggcccgaagaatgtgtattcggggtaggctctgagtcgttcgtatcgggtgccgtcggggctggatttgcctgtgcgctgtttgagtacggcgatgcgtgcctcggcggggatggtgagcccgttgccgttgtcttcgccaccatacagggagactcccaatatgagttgtggtttttcggagaggccgtttttgatttcccgcctagccggggggtgttcgatgtcggagccggttttgtcggtggcgtggtgggtgacaataatggtggagccagtatccctacccaatgctgtgatccattgcatggcttcctgttgggcctggtagtcggattcgcagtcttgaatgtccatcagattgtcgataacaatgagtggtgggaaggtgttccacatttccatgtaggcttgcagttccatggtgatgtctgtccatgtgatgggtgactggaatgagaatgtgatgtgttggccgtggtggatgctgtctcgatagtattctggcccgtagtcgtcgatgttttgttgtatctgggcggtggtgtgttgggtgttgagtgagataattcgtgtggaggcctcccagggtgtcatgtcccctgatatgtagagggcgggctggttgagcatcgctgtgatgaacatggctagcccggatttttggctgccggaccgccccgcgatcatgaccaaatcccctttgtgaatgtgcatgtccagattgtcatacaagggtgctagttggggtatgcggggcagttcggcggctgtttgggaggctctctcgaaggatcgttggagagagagcatcggagccttaatctatctgtctatcggttggatgatgttttggtggtcagatggagtcgatgtcgatgtcagcatcagttgaggctgtggtgtcgtctagctggccgttatcgcgtttgtctacgtattcggcaaccttatcgtagatggcgtcgtctaatggtttgagcacgaccgcgttgaacccgtttttggtgcgcacggtggcgagtttgaatgcctgttcttcgccaaggtaggcttctaggtcgcggatcatggagtgtgggcggtcgttgttgccgcgggctttctcgataatggcgttggggatggtttctggggtgccgttgttgagatcgtctagggtgtggaagattgtgacatcagcgtagatgcgatcggcgacctgtccaccgtagccttcggtgttgtgctggacgtcgtggattttgaaggcgatggcggtggcgtcctggtttcgggacgggttgaagaaggtgctgttgctgttgttgcggtagtttgcgagtcccattgttgtttcctttactgtttgtgttgttttgtttgttggtttgtgtcggtttttatcgggtgaggctgtttcgtttgctgcggaaagcctcagacacgtcactgttactagtgatggtcttcttgtactgtttgaggaggtcggctagctgtgccttgcttgtggcattgttaattttgtcgatgatggtgttgtttccttctgaggcgatgttgtctacgtagtctttggctgcctggttgtatcggtcttggaggatgatggatgctgtggcgatcagtgttgccaggtcccagttccgtgccgcggagctgtttttgagtccgcctagcaggtcgatgatagccttctttacctggtcggcggtgtctccgcggatgacggtccatggggcggcgtagtcgcctccgtatttgagtgtgacggtgaatcggtcgtcgtctgtgttgtcggtcactggtgctccttgccttcttttgttggggctgtgatggtggtttctatagggtacctgtaggcgtctttcccgttaacagcccagcaggcgtccttgacggggcatcctttacagagtgctgtgacgtggggtacgaagatgccttcgctgattcctttcattgcttgactatacatggatgatacatgccggtaggtgttgttgtcaagatcgtagagttcggtggatgtgccctgttcgaccgattgctcgtctcccttggtggtggcgggtgtccaaaacatgcctttcgtcacatcgttgccgtgttgggcgagcatgtaccggtatgtgtgcagctgcatactgtcggcgggtagacggccggttttgaggtccaaaatgaaggtttcgccagtgtcggtgtcggtgaagatacggtcgatgtagccaacaatcttggtgccgtcgtcgagggtggtttctaccgggtattcgatgcctggctggccgtcaataacagcggtgatgtattctgggtggttgcgcctccatgttttccaccggtccacaaaggtggggccgtatatcatccaccaattgtagtctttcttgtgtggcccgcccgactcgcacatgtttttgcacaccctgccggagggtttgatttcggtgccttcggattcagcgagggcgacttgggtgtcgaaaatgtttgtgaaggatgagagtttgtctggcagtgcagggtattcgtcgggattgtacaggtgtaggtcgtattgttcggtgatgtggtgtatggcgcttccggcgatggtggcgtaccaggtgtggtgttggacatggtacccgtgggataggcgccatttttctccgcattcagcccactgtgacagtgatgagtaggagatgtggcctggatggtgtatggttttcgggtattgtgctaggggcattacttgtcgcttttgttccatgggttgcgggtgtcttggccggcatcgtgttgctggtaggcgaggagtgcgaggcagtgccaggcagcatgggccaggtggggtagcccggattcgtggtcgaggttgttgccttgctgccatgatagtaggtgccggtagagggcgtcgacactgtggctccacgggtatcctccggtccagttgttgtcgccatatttggtggcgccgtagcctgccacggagccgagggcgtgtaaggctgtggggtcgatgagggatagcctgcaaagtttgagttcttttcgggcaccggtgttggggtcggtgtacatgcgggttggcttatccatggggtgtgtgctccttagaggtgggttactggttggggttgtgggcgagggcgacggcgagaataatgatggcgagggtttcagcaataagtatgggtgttgtgatcatttagtgtctcggggattgttggtgagtgtggaggcacccaggagggtggcgagggcgcatgcggcaataatggcgagggcggctttgtggctggtgccggttgcgtacatccatgtgatgatgccgccttggatccaggctaggctggtgaagaacgtttcgtagctgtgtagctcaatgttgttgttgagtgtgttcatgcttgctcctgaagaatggtgttgatggttttataaatgttgtacaggtcggtttcaatagataacagttggtggatttcgtggtcgagatcaatgtctgggttgagggtgttgatgcgggaggcaatatcggtggctgtgcgtagtgtgccgccggtgtggtgaataatgtgtgccgtgtcggcgagtccggtggtgacagcgtagtgggataggagaggcatagcgggggaatgctccttggcgggttactgttgcgggttgatgttgaggtcggtgacgtgcgggtggtcttctgttccggtgacgaggcagtggacggtgactgggagtttggatgcgccgggctgtttcgcggttgcgccgtagatgatggagaatgtgtctttaccgatggttttgtggagttggaggtcgatgtcggggttgccgttccagttgacgccgtgtgcggcggcctgttgtgcggctttcttgttgcaggtgtgtgctgccgtgatcatggtgagtccggtggcggtttcttcaccccttgcttgggcttgcttgtgggctttccgctgttcggctcgcagtgactgttctgcggctgcctggcgggctttcttttcggctttgcgctgccggacggttttgggtgtccattcggtgttggctgtggtggcctgtggggctggcatgaatgaggcggcggcgatgatggcggctgtgatgcctgcgatggtgtatccgtttttcttgttcatgactttgtgttcccctttccggggtgttgttcgttgctgacataattaatcatggtgtgggcggtggtctgtgtcaaggctgcgctcaacgattgtgagcgattcgtgtgtggctaggggttttatcggctgtacagggtgagtaggtggccaacattgatgcggctcacattccagtagagttgcgtggcttcacccccggtgagtggcttccactcgttgtggctgaacacggttccatcggatgctatgaatgtgttggggcgtagcttgtggagttcggcttccacgctctgccggtaggcttcggcgaggccctcaaaatccatgtggtcgcaggataggttttcgaggcgtgtcaggtcgaagggtgtggggcagtcgtagctggcgggggtgtagagctgggtgaagtggttggcgatcttctgcataattatgtccttttcgttgcttataacgttgttgagggtttatcgggtggatgcgacaaggatggcgtctacgtcgatcatgtcgatgagatcgtggagttcctcggcctcattctcggagaggtggcgccagtcgtagtcgccgtacacggcgccgtcgagggtgacagtccacagaggccggatgagtcgtatggcttcttgtactttagcgtggtacatgcggcgcaccatatccagatccatgtcgtctgaatggtttccgatgaggctgtggaggctgagtgggtcgatttctgtctgcctgtagaggctggtgaatgatggtgtgatgagtgtgccatccatgagggtgtgctcctttcggtggtgtaggggttgttgtggtttctagagtgtgcgggctgcgaccccatagtcaaggctgcgctcattcggattgagcgtttcatgctggagtgtcgggtgtgacagatgtcactgaagtctttattgcctctcccagcgtctcaaatcttctaggggtaggattatatagggttgaccctgctgatcgattctagggcccttcgagggcgtatcaggggtatgtctaagttatggcaggtgtggcagagtattgagtgagtcaaagtgccgagcttagacataagatctatcatctaggtgtgtgagatgtatcacactctcctggcttggtgtgcaccctcaaggccactctgccaatctggcgtgaagggtgtagcccagaaataccgtttaaagccttcacacggcgcctaggagcgccttacagggtgggggctaggtattcatacccccaagcaattctgatcgattctagacgcctcccagagcctcatacgcgatcagccatctcggcatagaccaccagcccctatcctggttagctaagcctcaactatgtggacagtgtgggatactgtgggggaagaaggacgcggtacaagaaagagggggggagcatcagccttagggtcttagcactgatgggcttagcaccgagcccctcaagggctcggcatcagcctgacagcccgagcaggctcagccgatcaggcacagcactgaaaggagtacacgccatcagggaaggcttgagagtacgaggagccctagcgacgagtactcgaaagcctgagggaacacccatcagcactgatgggcctagcgtgttcggaaaggacacaggggtaaggtgtgacagctgtccgggagtgaaacccgttctgactaggggtttcagccttaaccaccctcaaaggttacaagactctaagaaaatttaaggaaaagtttaggtttaatttttggacctttactaccaaaaacacccgtttacacccctcaaacccgcctatagagccaaaaccaccagtttgactcatcccaggtggggtatgataggctggacaggtagccagctggacgcaaggccggaaagtgctaacgcacttcccaacctcgcttaccatcagtctaccaaacactttaaagattcaaggcttagcgctaagcccttaagaccttaacgctgaacaccgagcccctcaagggctcggcatcagttttaaagccttaaagtcttaaagtacatatataaccttaacagttaaacgttaaaagctttaagccttaacacctaagttaagtataaaaccttaaaggctaagcacttaaggatataaactttacatcagtgtttaagactttaaaacttaaaataactattaagactttaaagcttataagctttaaacacttaaagtaactataaaacattaaagaccttaagtacttaaagttaaacatcagtcttaaactttactatgataacctataagtcttaaagcttataggtataataatataatataagtattaaagcttataagttataaaagttttagaagagttaaggggttaacttctttacttctcttctctctttggttcttcctctcttctcttcttttcttcatcaggggagaagaggaacctttaaccgtcaacactgatggactttcaaccgtgtgtctcgtgtaccaccggtcgcacgctcccggtttgtacattccccacactctgacacccgtgtccctttacggcttggcgtgttcggctgaaggcgtacggcgtgtcacgccaacacccttaacaccgggtaagacttaaagtgcatattatatgtagaagactttaaaaacctgtcaggtgttcccgttgagcctgtgtcctacaccgctaagtattaagtgctaggcgccaagcggtaagctgtgaaacgcgaacacccacccccctttttctttcgtgtccttctctttttgacacagctggggggcgatgtgatctttttcacacccatggggggtagtggagaaaacaaccaccccagcaagttcaagacaccccctcaaacgaacaaaacagcccccagaatcgaacagcagggcaagggcaaggtattcatacccccaacggttcccaagcccttagagaggcaatgagaggctcgcaggggtcataggagatcgggggacgtgatggcacacaccaaccgcaccgcatcctccgcccatcggcgctggcgggcaagactcatcacccaagcccgacaacaaggccaaaccgaatgcccactctgcggagcccagatagcctggggcacacatgacctgccaaccagccccgaagccgaccacatcacacccgtcagccggggaggactcaacaccctcgacaacgggcaaatcatctgcagaacatgcaacagaagcaaaggcaatcgcagcgaaccaaacattcaattccaacaacaaaccacaaaaacgttgattccatggtgaaaaacctgtcaacccccaccggggacaccccctgcacacccgtgcaagacc

SEQ ID NO: 37 - DNA, 29464 bp, Unknown
  source: /note="Description of Unknown: Bacteriophage of P. acnes"
agtgaaatacctcccttttgttgttttatcgttttgtcgacatttcttgttctgtgtttggtggtgttgatggtgcagcctgagcttcctgagggacatgagtggtgtggggagacgcgtcattggtggcgtgtgtggggtgaagatgcgcgtgcccagtttgtgtctgatgaggagtggctgtttctccttgatgctgcggtgattcatgatgtggtgtggcgtgaaggcagggcggaccttgtggcttcgcttcgtgctcatgtgaaggcgtttatgggcatgttggatcgttattcggttgatgtggcgtctggtgggcgtggcgggggttctgctgtggcgatgattgaccggtatcggaagcgtaagggggcctgattaggtgtctggtgttgttggttctcaggttcctcgtcatcgtgttgctgcagcctattcggtgactgctggcggggatgctggtgagcttggtagggcttacgggttgacgcctgatccgtggcagcagcaggtgttggatgattggctagcaatcggggctagtggtcggcttgcgtctggtgtgtgtggggtgtttgtgcctcgccagaatggcaagaatgctattttggagattgtggagttgtttaaggcgactattcagggtcgccggattttgcatactgctcacgagttgaagtcggcccgtaaggcgtttatgcggttgaggtcgttttttgagaatgagcggcagtttcctgatctttatcgtatggtgaagtcgattcgtgcgacgaatggccaggaggctattgtgttgcatcatccggattgtgccacgtttgagcgtaagtgtggctgtccgggttggggttcggttgagtttgtggcccgttcgcgtggttcggctcgcgggtttacggttgatgatttggtgtgtgatgaggctcaggagttgtcggatgagcagttggaggcgttgcttcctacagtaagtgctgccccgtctggtgatcctcagcagattttccttggcacgccgcctgggccgttggcggatggttcggtggtgttgcgtcttcgtgggcaagcccttggtggcggtaaacgtatcgcctggacggagttttcgattcctgacgagtcggttccggacgatttatcaaggtcttggcggaagttggcgggtgacacgaatccggctcttggtcgtcgtctgaatttcggtacggtgtctgatgagcatgagtcgatgtctgcggcggggtttgctcgggagcggcttggctggtgggatcgtggccagtctgctgcgtcggtggttcctgctgacaagtgggcccactcggcggttgatgatgttgagcttgttggcggtaaggtgtttggtgtctcgttttctcgttcgggggatcgggttgctttggctggtgctggccggactgatgctggtgttcatgttgaggtgattgatgggctgtctggaacgattgttgatggtgtggggcagcttgcggattggttggcgttgcgttggggtggcacggatcggattgtggttgccggctcgggtgcggtgttgttgcagaaggccttgacggatcgtggtgttccgggccgtggcgtggtggttgcggatactggggtgtatgtggaggcttgtcaggcgtttcttgagggtgtgcgttcgggtgttgtgtctcatcctcgtgctgattctcgccgtgacatgttggagattgctgtgaggtcggcggttcagaagcgtaaagggtctgcgtggggttggggttcctcgtttaaggatggcagtgaggttcctttggaggctgtgtctttggcgtttttgggggctaaacagttgaggcgtggccgtcgtgatcgtggtggtaggaagcgggtgtctgtggtatgaactcggatgagctaaatctgattgagggcatgtttgatcgtatcagggggttgtcttcgtggcattgccgtattgagggctactatgagggttctagccgggtgcgtgatttgggggttgctattcctcccgagttgcagcgggtgcagacggtggtgtcgtggcctggtatagctgtggatgctttggaggagcgtctggattggcttggctggactaatggtgacggctacggtttggatggtgtgtatgctgcgaatcggcttgctacggcttcgtgtgatgtgcatcttgatgcactaatttttgggttgtcgtttgtggctgttattccgcaagaggatgggtcggtgttggttcgtcctcagtcaccgaagaattgtactggccggttttctgccgatggttctcgtctggatgcgggtttggtggttcagcagacgtgtgatcctgaggtggttgaggcggagttgttgttgcctgatgtgattgttcaggtggagcggcgcgggtctcgtgagtgggttgagacgggccgtatcgagaatgtgcttggtgcggttccgttggtgccgattgtgaatcgtcgccgtacttctaggattgatggccgttcggagatcactcggtcgattcgtgcttacactgatgaggctgtgcgcacgctgcttggacagtctgtgaatcgtgacttttatgcctacccgcaaaggtgggtgacgggtgtgtcggctgacgagttttctcagcctggctgggttctgtcgatggcttctgtgtgggctgttgataaggatgaggacggtgacacgccgaatgtggggtcgtttccggtcaattcgccgacaccgtattcggatcagatgcgcttgttggcgcagttgacggcgggtgaggcggctgttccggagcgctatttcgggtttattacgtctaatccgccttcgggtgaggctttggctgctgaggagtcgaggcttgtgaagcgtgctgagcggcggcaaacgtcgtttggtcagggctggctgtcggttggttttctggctgccagggcgttggattctcgtgttgatgaggcggacttttttggtgatgtgggtttgaggtggcgtgatgcttcgactccgactagagctgctacggctgatgctgtgacgaagcttgttggtgccggtattttgcctgcggattctcggacggtgttggagatgttgggtttggatgatgtgcaggttgaggctgtgatgcggcatcgtgccgagtcgtctgacccgttggctgcgcttgctggagctatttcgcgtcaaactaacgaggtttgatggatggtttcgggtgtgatgtcgaggctggctgcgactgagtatcagcgtgaggcggtcaggtttgctggaaagtatgcgggctattatgccgagctgggtcgtttgtggcattctgggaagatgagtgacacacagtatgttcgtctatgtgtggagttagagcgtgccggtcattatggttcagcagcgctggctggcaagtttgtttcagattttcggaagcttaacggtgtcgatcctggtttgatagtgtatgacgagtttgatgctgccgccgctttggctaggtcgttttcgactatgaagattcttaatagtgacccggatagggcgaatgacactattgatgcgatggcggccggtgttgatcgtgccgtgttgaatgctggtagggatacggttgagtggtctgcgggtgcgcagggccggtcgtggcgtcgtgtcacggatggtgatccgtgtgctttttgtgccatgttggctacgaggtcggattatacgaccaaggaaagggcgctcactacgggtcatactcggcgtcataagcgtggtggtaagcgcccgtttggttcgaagtatcatgatcattgtgggtgtacggtggttgaggttgttggcccttgggagccaaatagggctgatgccgagtatcagaggacgtatgagaaggcccgcgagtgggttgatgatcatgggttgccgcagtcgcctggcaatattttgaaggctatgcgtactgttggcgacatgagataaatggtttccggttgtgcgccgccggttatcggtgtacgggttgtctcccgcacggggggcggcaagattggtgttgttttccgcaaggagtgtagggttaggctatggccgatcagaatgttgaagaacagaatgtcgacaatgatgttgtggagtccggaaaggataatggcattgttgatacagtaaaagacgatggcgggcaggatgtagccgacaatcagttgaagaatgaaggcgagggtaaatcgtctgggactgattggaaggctgaggcccgtaagtgggagtctcgtgctaaaagtaatttcgccgagttagagaagcttcgcgcctcggatggtgatgcggggtctactattgatgagcttcgccgcaagaatgaggaactcaaagaccggatcaacgggtttgttcttgagggtgtgaagcgcgaggtggctgccgagtgtggcctgtcgagtgatgcgatcgctttcttgtcgggtggcgataaggagtcgcttgccgagtctgcgaaagctttgaagggtttgatcgaccatagtagtggtggcgcgggtgtgcgccgtcttgcggggagtgcccccgttgatgatgttaaacgacgtgagggtgtcgcgtttgtggatgctcttgtcaataattctaggagatgatttgtgatggctgacgattttctttctgcagggaagcttgagcttcctggttctatgattggtgcggttcgtgaccgtgctatcgattctggtgttttggcgaagctgtcgccggagcagccgactattttcgggcctgtgaagggtgccgtgtttagtggtgttcctcgcgcaaagattgttggtgagggcgaggttaagccttccgctagcgttgatgtttctgcgtttactgcgcagcctatcaaggttgtgactcagcagcgcgtctcggacgagttcatgtgggctgacgccgattaccgtctcggtgtgttgcaggatctgatttccccagccctgggtgcttctattggtcgcgccgttgatcttattgctttccatggtgttgatccggctaccggtaagcctgccgcggctgtcaaggtatcgctggataagacgtcgaagacggttgatgccacagattctgccacgaccgatctggtcaaggctgtcggtttgatcgctggggctggtttgcaggttcctaacggtgtcgccttggatcctgctttctcgtttgcgctgtctaccgaggtgtatccgaaggggtctccgcttgccggtcagccgatgtatcctgccgccggtttcgcggggcttgataattggcgtggcctgaatgttggtgcttcttcgactgtttcgggtgccccggagatgtcgcctgcctctggtgttaaggctattgttggtgatttctctcgtgtccattggggtttccagcgtaacttcccgatcgagctgatcgagtatggcgatcctgatcagactggtcgcgaccttaagggccataacgaggttatggttcgcgctgaggcggttctgtatgtggctatcgagtcgcttgattcgtttgctgttgtgaaggagaaggctgcaccgaagcctaatccgcctgccgagaactgatttattgttgcggtgatgtgtacatgtgcagggggtggtgttgatgggtatcattttgaggcctgaggatattgagcctttcgccgatattcctaaagataagcttgaggcgatgatcgctgatgtggaggctgttgctgtcagtgtcgccccctgtatcgctaaaccggatttcaagtacaaggatgctgctcgggctattttgcgtagggcgttgttgcgctggaatgatactggcgtgtcggggcaggtgcagtatgagtctgcgggtccgttcgcccagactacacggtctaatacgcctacgaacttgttgtggccttctgagattgctgcgttgaagaagttgtgcgatgagagtggtggcgccggtaaagcgttcacgatcacacccacgatccgtggtggatatacacattctgaggtgtgttctaccgtgtggggtgagggttgttcgtgcggatctgatattaacggctacgatggccctttgtgggagatataggatgactggttttcctttcggtgagactgtggtgatgcttcaaccgactgttcgtgtcgatgatcttggcgacaaggtggaagactggtctaagcctgtcgagactgtgtaccataatgtggctatctatgcttccgtttcgcaggaggatgaggcggcaggccgtgactcggattgggagcattggacgctgctgttcaagcagcctgtcaagggtgccggttatcggtgtcgttggcgtattcggggtgttgtgtgggaggctgacgggtcgcctcttgtgtggcatcatccgatgtctggctgggatgctggtacgcaggttaatgtgaagcgtaagaagggctgataggtagtggctcagaatgtgaatgtgaagcttaatcttcctggtatccgtgaggtgctgaaagcgccgggtgtgcaagctatgttggctgagcgtggcgagcgtgtgcggcgtgccgccgcggcgaatgtgggcggtaacgctttcgatagggcccagtatcgtggtgggttgtcgtctgaggtgcaggttcaccgtgttgaggctgtggcgaggattggcaccacctataagggtggtaagcgtattgaggctaagcatggcacgttggcgaggtcgattggggctgcgtcgtgatcgtgtacggtgatcctcgcgtgtgggctaaacgcgtgctcaaggatgatggttggctgtcggatgtgccgtgtactgggactgttcctgaccggtttgagggtgacctgatttggttggctcttgatggtggcccggagttgcatgttcgtgagcgtgtttttttgcgtgtgaatgtgttttcggatatgccggatcgtgctatgtcgttggctcgccgggttgaggctgtgctgtctgacggggtggatggggatccggtggtgttttgtcggcgttctactggtcctgatttgttggtggatggtgcacgttttgatgtgtattcgttgtttgagctggtgtgccgtcctgtcgaatccgagtaaacgttttgttttgatattgttttaattgtttgtttgatattgtttttgggggttgtgatggctgctacacgtaaagcgtctaatgttcgctctgctgttacgggcgatgtctatattggtgccgctcatgctggtgacactattgatggtgttgggaagattcctgacggtcttaccgcactgggttatctgtcggatgacgggtttaagattaagcctgagcgtaaaactgatgatttgaaggcttggcagaatgcggatgttgttcgcactgttgccaccgagtcgtctatcgagatttctttccagctgatcgagtctaagaaggaggttatcgaactgttttggcagtcgaaggttactgccggagtcgattcgggttcgttcgatatttctcctggtgctacgacgggtgttcatgccctgttaatggatattgttgatggggatcaggttatccgctactatttccccgaggcggagcttgttgatcgtgacgagattaagggcaagaatggcgaggtttacgggtatggtgtgacgttgaaggcgtatcctgcccagattaataagaagggtgatgcggtgtctggtcgggggtggatgacggctttaaaagctgatactcccccggttcctccgaagcctcagccggatccgaatccgccgtccgataactgacacacattataagggattgttgatagatgagtgacacaggtttcacgttaaagattggtgaccgtagctgggtgttggcggatgcggaggagacggcgcaggctgttcctgcccgcgtgtttcgccgtgccgctaggattgcccagtcgggggagtctgcggatttcgcccaggttgaggtgatgttttctatgttggaggctgccgccccagaggatgctgtggaggccctggaggggcttcctatggtgcgtgtggccgagattttccgccagtggatggaatataagcctgacggtaaaggggcttccctgggggaataatttggctccacggcctgattgatgattatcgtggggccatcgaatacgattttcgcactaaatttggtgtttctgtttatagtgttggtggcccgcagatgtgttggggtgaggctgtccggctggctggcgtgttgtgtactgacacgtctagccagttggcggcccacgtgaatggttggcagcgcccgtttgagtggtgcgagtgggcggtgttggacatgttggatcattacaggtctgctaatagtgaggggcagccggagcctgtggcgaggcctactgatgagcgcagggcgaggtttacgtctgggcaggtggacgatattttggcgcgtgtccgcgctagtggcggggtgtctcgcgagattaatattatggggtgaatagtgtatgtctggtgagattgcttccgcatatgtgtcgttgtatacgaagatgcctggtttgaaatcggatgttggtaagcagctttccggggttatgcctgctgagggtcagcgttctggtggtttgtttgcttctgggatgaagttggcgcttggtggcgcggcgatgatgggtgccatcaatgttgctaagaagggtctcaggtctatctatgatgtgactattggtggcggtattgctagggctatggctatcgatgaggctcaggctaaactgactggtttgggtcacacgtcttcggatacgtcttcgattatgaattcggctattgaggctgtgactggtacgtcgtacgctttgggtgatgcggcgtctacggcggctgctttgtctgcttctggtgtgaagtctggcgggcagatgacggatgtgttgaagactgtcgcggatgtgtcttatatttctggtaagtcgtttcaggatacgggcgctattttcacgtcggttatggctcgcggtaagttgcagggcgatgacatgttgcagcttactatggctggtgtgcctgtgttgtctctgttggctaggcagacgggtaaaacgtcggctgaggtgtcgcagatggtgtcgaaggggcagattgattttgccacgtttgcggctgcgatgaagcttggtatgggtggtgctgcgcaggcgtctggtaagacgtttgagggcgctatgaagaatgttaagggtgccctgggttatcttggtgctacggctatggccccgtttcttaacggtttgcggcagatttttgttgcgttgaatccggttatcaagtctgtcactgattctgtgaagcctttgtttgcgtcggtggatcaggggattcagcgtgtgatgccgtctattttggcgtggattaatcgtatgcctggcatgatcacgagaatgaatgcacagatgcgcgccaaggtagagcagttgaagagcatttttgcgagaatgcatatacctgtcccaaaggtgaatttgggtgccatgtttgctggcggcaccgcggtgtttggtattgttgctgcgggtgtggggaagcttgttgcggggtttgccccgttggcggtgtcgttgaagaatctgttgccgtcgtttggtgctttgaagggtgccgctggcggtctgggcggcgtgtttcgcgccctgggtggccctgtcggtcttgtgatcggcttgtttgcggcaatgtttgccactaacgcccagttccgtgccgctgttatgcagcttgtgggtgttgtcggtcaagcccttggccagattatggcggctgtgcagccgctgtttggtttggttgcgggtgttgtggcacagttggctcccgtttttggccagattattggcatggttgccggtttggctgcccagcttgtgcctttgattagtatgcttgttgcccggctggttcctgtgatcacgcagattattggtgcggtgacgcaggttgctgccatgctgctgcctgcactgatgccggtgttgcaggctgtgatggctgtgatacggcaggttgttggtgtgatcatgcagctggtgcctgtgttgatgcctgtgattcagcaggttttgggtgctgtcatgtctgttctaccgccgattattggtttgattcggtcgctgataccggtgatcatgtctgttatgcgtgtagtaatgcaggttgttggtgccgtgttgcaggtggtggcccgtattatgccggttgtgatgccgattatgacggctgtgatcgggtttattgcacgtattcttggtgctgtcgtgtctgccgctgcacggattattggttctgtaactcgtgttatcgcctgggttgtgggccatttggtgtctggtgtggcgcgtatgggttcggctatcctgaatggctggaatcgtattagagcgtttacgtctgcgtttattaacggtttcaagtcgatcatttctggcggcgttaacgcggttgtgggggtttttgcgcggctgggttcttcggttgcctcccatgtgaggtctggttttaacgcggcccgtggtgctgtttcttccgccatgaatgggatccggggtgtggtgtcttcggtggcgtctgctgttggcgggttcttcggctcgatggcttctcgggttcgtggtgccgcctcgtccgggtttaacggggcacggagtgtggcttcttctgctatgcatgctatgggctcggctgtgtctagcggtgtgcatagtgtgctgggttttttccggaatctgcccggcaatattcggcatgctctcggtaatatggggtccctgttggtgtctgcgggccgtgacgtggtgtctggtttgggtaatgggatcaagaatgctttgagtggcttgttggatacggtgcgtaacatgggttcccaggtggctaacgcggcgaagtcggtgttgggtattcattccccgtctagggtgtttcgtgacgaggttggccgccaggttgttgctggtttggctgagggtataacaggtaacgcgggtttggcgttggatgctatgtctggtgtggctggaagtctgcctgacgctgttgatgcccggttcggtgtgcgatcgtctgtgggctcgtttaccccgtatggcaggtatcagcgtatgagcgataagagtgttgtggtgaatgtgaatgggccgacgtatggggatcctaacgagtttgcgaagcggattgagcggcagcagcgtgacgctttgaacgcgttggcttacatgtgatagggggtgtggttcatgtttcttcctgacccgtctgatcgtgccggtttgactgttacttggtctatgttgccgttgattggtaatgatccggagcgtgtgcttcatttgacggattatacaggtgcgtctcctgtcatgttgttgaatgattcgttgcgtggcctgggtgttcctgaggtggagcatttttctcaaactcatgttggggtgcacggctcggagtggcgcgggtttaatgtgaagcctcgcgaggtgacactaccggtgttggtgtcgggtgttgacccggatccggtgggcggttttcgtgacggttttttgaaagcctataacgagttgtggtctgcttttcccccgggcgaggtgggggagttgtcggttaaaaccccgtctggtcgtgagcgtgtgttgaagtgccggtttgattcggtggatgacacgtttacggttgatccggtgaacaggggttatgcgcgctatctgttgcatttgacggcctatgacccgttttggtatggggatgagcagaagtttcgttttagtaacgcgaagttgcaggattggttgggtggcggccctgtcggcgggaagggtaccgcttttccggtggtgttgacgcctggtgttggttcgggttgggataatctgtctaataagggtgatgtgcctgcgtggcctgtgattcgtgttgaggggcctttggattcgtggtctgtgcagattgatggtttgcgtgtgtcttcggactatcctgtcgatgagtatgattggattactattgatacggatcctcggaagcagtctgcgttgttgaacgggtttgaggatgtgatggatcgtctgtctgagtgggagtttgcgcctatcccgcctggcggttcgaagagtgtgaatattgagatggttggtttgggtgccattgttgtgtcggtgcagtacaggtttttgagggcttggtgaatagttgatggctggtcttgtcccgcagataacattgtttacgccagactatcgccgtgtggcgcctatcaatttttttgagtcgttgaagttgtcgttgaagtggaatggtttgtcgacgctggagttagtggtttcgggggatcattccaggcttgacgggttgacgaagccgggtgcacgcctggttgttgattatggtggtggccagattttttctgggcctgtgcgtaaggtgcatggtgttggtccttggcggtcttcccgtgtgactatcacgtgtgaggatgatatccgcctgttgtggcgtatgctgatgtggcctgtgaattatcgccccggtttagtgggttcggagtggcgtgctgacagggattatgcccactattctggtgcggcagagtcgattgctaagcaggtgttgggggataatgcttggcggtttccgcccggtttgtttatgatggatgatgagcgtcgtggccgttttattaaggattttcaggtgcggtttcacgtgtttgctgacaagttgttgccggtgttgtcgtgggctcggatgactgtttcggtgaaccagtttgagaatgcgaagtttgatcagcgtggtttagtgtttgattgtgtgccggcagttactcgtagccatgtgttgactgccgaatcggggtcgattgtgtcgtgggagtatgtgcgtgacgcccctaaggctacttcggtggttgtgggtggccgcggcgagggccgggatcggctgttttgtgaggatgttgattcgatggctgagggggactggtgggatcgggttgaggtgtttaaggatgcccgtaacactgattctgagaaggtgtctctcttcgatgaggctgagcgggtgttgtccgagtcgggggcctcgtcggggtttaagatcgagttggctgagtcggatgtgttgcgtttcgggccgggcaatctgatgccgggtgatcttatctatgtggatgtgggttctggtcctattgcggagattgttcggcagattgatgtggagtgcgattcgcctggtgacgggtggacgaaggtgacaccgattgcgggggattatgaggataatccgtcggcgttgctagcacggcgtgttgccggtttggctgccggtgtgcgggatttgcaaaaattctagttgattggggtttgttgtgggtattgtgtgcaagggttttgatggtgtgttgaccgagtatgattgggctcaaatgtctggtctgatgggtaatatgccgtcggtgaagggcccggatgattttcgtgtgggtacgacggttcagggtgccacggtgttgtgtgaggttctgccggggcaggcttgggctcacggtgtgatgtgcacgtcgaatagtgttgagacggtgacggggcagctgccggggccgggggagacccgctacgactatgtggtcctgtcgcgggattgggagcagaacacagcgaagttggagattgttcccggtggccgtgcggagcgtgcccgtgatgtgttgcgcgccgagcctggcgtgtttcatcagcaactgttggctactttggtggtgtcgtctaacgggttgcagcagcagttggataggcgtgctatagcggcccgtgtggcgtttggcgagtctgcggcgtgtgaccctacccctgtggagggtgaccgtgtgatggttccttcgggggctgtgtgggctaaccatgcgggcgagtgggtgcagttgtctccgcgtattgagacgggttcgaagtcgatcatgtttggtgggtctaacgtgtatgcttacacgatctcgtttggacgggagtttacgtctccgcctgttgtggtggcgtctatggggacggctgctggtggcaccacccagattgatgtgaaagcctacaatattactaccaaagattttggtttggcgtttatcacgaatgatggttcgaagccgaatggtgtgcccgcgattgcgaattggattgctgtcggcgtgtgactgtacaggtgttgtggcggatggtgtgatgttgggggggctgtggtgtcgtggtttactcctgcactggtggcctctatctgtaccgcgttggccactattttaggttctgttcaggcggtcacgtctaaatcgaggaagcgtttacggaggctgtctgcgcaggttgattcgatggaagagtatacgtggggtgtgcggcgtgaggttcgccggtttaacgctggtcttcctgatggggttgatccgcttgttttgcctgatccgcccggttttttgcaggattcattgggggggtgagtgatgagggagttggaggaagagaagcggcagcgccgcaattttgagaaggcttccctgctgttgttgttcctgtcacttgtactactggcggtggttgctgggggtgctttgcgtttcggatcggtgtcttctgagcgggattcggagcaggctagggccgagtctaatggtatagcggctaaaggtttagccagtcgtgtaaagcaggtgtgtacccagggtggtgtggagtctgttaagcttcaccgttctggtttgtgtgtggatgctgcccgcacggagcgtagcgtagcgggtgtgcagggtcctgccggtgagcgcggcccgcaagggcccgccggtgtggatgggcgtaatggtgttaacggttcggatgggcttgttggccctgttggtccgccgggttccccgggtttgaatggtgtgaacggtcctgacgggttgcctggggctaacgggtcggatggccgtgatggtgtccgtggtcttgcgggtgctgatggtaaagatggcgtgaaaggggatctgggcgatactggtcccgctggtgagcctggtgcgcccggttctgcgggttctgccggcacgcaaggtgcacagggtgaacggggtgagcgcggccctgccggtgtgaacggatctgatggtaaagatggtaaggatgggcgtgatggccgctcggtggtgtccgtgtactgttctggggggcgcctggttgtgaaatatagtgacggtgtggcttccacgatatcgggttcggtggcctgcgagagtgtgaaaccgtcgccggtggttaccgtgtcatcccgcaaatagcagaagaggaaagggtgttactggtgttgatgatgtttgggggtggtgtgcggtgagatacattccagcggcgcaccattctgccggttctaatcatccggtgaatagggttgtgattcatgcgacatgcccggatgtggggttcccgtccgcctcccgtaaagggcgggcggtgtctacagcaaactattttgcttccccatcgtctggcggttcggcgcattatgtgtgcgatattggggagactgtgcagtgcctgtccgagagcactattggctggcatgccccgccgaatccgcatagtttaggtattgagatttgcgcggatgggggttcgcacgcctcgttccgggtgccggggcatgcttacactcgggagcagtggcttgatcctagggtgtggcccgcggtggagcgggctgctgtgttgtgtcggcagttgtgtgacaaatataatgttccgaagaggaagcttagtgcagccgatttgaaggctggcaggcggggtgtttgcgggcatgtggatgttacggatgcgtggcatcagtcggatcatgacgatcccggcccgtggtttccgtgggacaggtttatggccgtagtcaacggcggtagtagtagtgatagtggggagttaactgtggctgatgtgaaagcgctgcatgatcagattaaacaattgtctgcgcagctcaccggttcggtgaataagctgcaccacgatgttggtgtggtacaggtgcagaatggtgatttgggtaaacgtgtcgatgctctgtcgtgggtgaagaatccggtgacggggaagctgtggcgcactaaggatgccctgtggagcatctggtattacgtgctggagtgtcgcagccggatcggcaagcttgaagccgatattgcccagttgaagaagtgatggtgatcgattgtgggtaaacagttttggttaggtttactggagcgggcggctaagacttttgtgcaaacgtttgttgctgtgcttggggtgactgcgggtgtgacttatactgcggagtcgtttcgcggtttgccgtgggagtctgccctgattacggccggggttgctgcggtgctgtcgattgctacctcgtttggtaacccgtcgtttgttgccggtaaaccgaaaacgacgcctgttgtggatgctgggcttgttccaccggatgatcctggaatagtggagtctcacatggttgacgaaacggatcctggcatgatcgagcctgtagacgatgctgatcttggtggctatgtgccgaagcgtgcagccgagtctgaggttggcacggtagagccgatcgaatgataagtgaatgtgtgtgtgccccagcggtgctgccacgattgtgtggtggttgctgctggggcactatttttgtgtctacaggggttttacaggttgtcgtctagggtgtcttcgagtgtctgttgtaggagtgcacactcggcgagggtgtcttcagcctggtcgacaatgttttgttttgctatgcctggatagttgttgcggtgattgtagatggcttccagaatgttgtctgccatgatttgtagtgttagggcctggttggtgatgcattccagctcgtctagggcggcctggctagcctccggctgccggttgtccggatgttctgcaaggttgcagtcccacaggatttcttggcatgcatccctggtgtctgcgtccacatcgatgtcgtctaggctgacaccgttggcgttgaggctgatgttgtcgaggttgatgggaaccagatattcgctgctgatgctgcaggtgatgtttgcgagttctgtcatgtttcgtggctgctgctgtatgatgcggcgggccgcggttttgagggctgtgactgttcggtgtctgttactgggcatcgtttctattcttcttccccggtgtagctggtggtgttggtgtactgggtgagtgtgatcaggcactggtcggcccactgtttcaccgtctgccgtgtcacacccaatcgttgggctgccaccgaataggtttgatcatacccgtagacttccctgaatgcggcaagccgtgctagccgtttccgctgttttgatggttcacatgtgagggtgtagtcgtcgatggccagttgtagatcgattatggttacaatgttgttgccgtgatgctggggggcggttggtggcggcggcattcccggttcgacggatggtttccatgggcctccgttccagatccattgggcggcttggataatgtcggctgtggtgtaggtttggttcacgggtcaccccctgaacaggtcgtcaaggctgttggtgttggtggtgtcgaatcgtcccacacagtggcagtagtcgtacatgagtttgataatgtgttggtggtcgcctaggtaggtgttgccgctgatactgtaggtggctgtgccgtctttgcttatggtgtatttggcggtgatggtttcgggtgtttctgtgttggtgatgatggctgtggtggtggagcctactgtttgtagcctggtggtttgggttccgtcgtcgaggatggtagtaaccattatggggttctccttttagttgctggtttggttgtcggctaggtgaataatatcggataaaggtttcggctggtctaggtgttgtatagttttgttggctagccgtttggctaccctgtaacacattttggtatagtgtttgttgtctaggttgtggtattgttcccgcaccgcaatatatagtagggagtcttggtacaggtcgtctgcactgattgcggggtagtgtgcggctgttttggtgcatgcccggttgagtgtgtgtagatgctggtttgtggcccatccccacgatgctgtggtggccaggtctgcttttgttggtcgtctactcatggcactatttcatctcgctatctgatagttgtttggtgttttgttgttgatagtgtagcacacgagtccggggtggccggtggtgcctgtgcggtgccggaaccatgtggattcgccttccatggatgggcattggatgaaggtgcgttgtccttgctcagagatttctaggtggtgccggtgcccggccatgaggatgtgggatgtggtgccgttgtggaattcttggccgcgccaccattcgtagtgttggttgttgcgccattggtgtccgtgggcgtgtaggatttgtgtgcctgccacgtcgacggtggtggtcatttcgtcccgctcagggaagtggaagtggatgttgggatactggttggtgagctggtaggcttctgcgatggcccggcagcagtccacatcgaatgaatcgtcgtaggtggtgactcctttgccgaatcgtactgcctcaccatggttgccggggatggatgtgatggtgacgttggcgcagtggtcgaacatgtggacgagttgcatcatggccatgcgggtgagcctgatttgttccgtcaagggtgtttgtgttcgccaggcgttgttgcctccttgtgacacgtatccttcgatcatgtcgccgaggaaggcgatgtggacccgttgcggttttcctgcttgctgccagtagtgtttagcggcggtgagggaccggaggtagtcgtcggcgaagcggctggtttctccgccggggatgcctttgccgatttggaagtctcctgccccgatcacgaacgcaacattactatctgttgtgctactggtggcgggttttgggggctgccagtcggctagcttagctacgagttcatccacgggataggggtctgttttgggttggtggtcaataattttttgtatggatcggcctgtttctccgttggggagtgtccattcggagatgcgtgtgcgccgtacggtgccgttggctagattgtcgtcgatggtatctgcttcgttgttgtggttggctagctgtgtgaggagccggtcaatattgtctatcactggttttcctcctcctcgttctgggtggtgttggtttgtttgcggcgatagtctttaatgacggtggcggagatggggtatccggcttgggtgagctgttttgctagccatgaggcggggatggttttgtctgcgagcacgtcggcagctttgttgccgtagcgttgaataagggtttcagttttggttgccatgatatcccatcggttgtgtggcgggctgccatcctgtgcggcagtcgccgtcgtgtcctggtttgcgtgtgcaccatgtggtagcaccgtcctggtggtggattgttttgccgcacatgacgtcccggagatgctcaggcagtgcgccgtcatcctggttgctggtttgtgtgtcgaagagtgttttctggttggtgaaatgctcggatacggtgccgttgtgtacgggtagtatccatgttttccattgctgctgtagccgagtgttccagtggaattgtttggctgcgttttcggcctgttttaaggttttgtagtagccgacgagtatgcgctgatgctgctgatcgggaggattttggcctcgccaatattgtgccgccacggcgtagcggttactgtctgtgaaggtgttccaacagtattcgataatgttgttgagtgtgtcgtctataacatctgtgtcgctgttgggtaattcttgggcgatgatgtcgcggatggcttgccggtttcgggtggtgggtttgaacgagatgctcacgatagtaccggctggtcgtcttgcatgaactggttgaaggagccgtctccagcatgtcgtgcctgtgtgatgtcctggtcggtccagtcggggtgctgctgtttcagatagtgccagcggcaggcgtcataggtttcgttttggagccgagtgagatggttttctgtgatgatgtgtttccacattgtccacgagacgtcgagtctgcggagcatgtccatggccggcacattaaacgagttaaggaagagtatttcgtgggtgtagtattccttctcgtactggtcccatccgcttcggtgtctgttgggctggtttttggggtaggcttcccggcatactttgtgcaaacgtttggccatgtctttgggtagcctcatgtcggggttggcgcggatcatggatcgcatcccatcataggtggtgccccaggtgtgcatgatatgtagtgggtcttcaccgtctgcccatttttctgcacagatggcgaggcggatgcgcctccgggctgcttggctggtgttgcgccggttggggatggggcacgtgtcgagaggatccatgatgtttcatatgcctttctttgtttgggttgcttgtgtggttttactgtagcacagtgttgagtgcttgtgtcaaccctgttttgccggcttgcaggtaggtgtctgtgacatccccaactgtgaggggcacatgggtggcttgggggagtgccgcctggagggtttgggccatctggtctcccgccttgtctgggtcggaccatatgtagatgtggtcgtagccttcaaaaaatttggtccaaaaagtttgccacgaggtggctccggggattgcgacggccgaccatccgcattgttcaaggatcatggagtcgaattcgccttcgcaaatgtgcatgtctgtttgcgggttggccatggcggccatgttgtagatggagcctgtgtctccggccggtgtcaaatatttggggtggttgtgggttttgcagtcgtgcgggagtgagcagcggaaacgcatttttcgtatctcggctggccgcccccaaacggggtacatgtatgggatggtgatgcactggttgtagtcttcgtggccgggtatggggtcattgtcgatgtatccaaggtggtggtagcgggctgtttcttcgctgattcctcttgcggagagcaggtcgagaatgttttcgaggtgggtttcgtagagggccgaggctttctggattcggcggcgttccgcaatgttgtatgggcgtatgctgtcgtacattcgggtttctttcttctagatattgttgtagcttgtggagtccgcctccgacaccgcatgtgtggcagtaccagactcctttgtcgaggttgatgctcatggagggctggtggtcgtcgtggagtgggcagaggatgtgctgctcgttcctggacgggttgtaccgtatgcgatattggtcgaggaggcggcatgtgtcagaggtgtgggaggagctcgttgagggttgataccacataggcttcactccatggcttgttgcgctgtttcatcactacgaggccgatagtggactggctggttttgtttcggtgtgtttcatagttccttgcctctcggctggcttgtttcacgaattcggcgaggtgtggctgtccggctttcgcctcgataatgtaggttttgttgccggtttggaggatgaggtcgccttcgtcttcgcgcccgttgaggtgaagccgctcgatattgtgtccggtgtcgcgtagctggtggaggagtctcgtttcccattcggcaccggcccgccggttgcgtgcctgctgtgaagccatcatagtcctttgtgtgttgtggtcatgttccatggctgtttttcggcgaggggcccgaagaatgtgtattcggggtaggctcgcagccgctcgtatcgggtgccgtcggggctggatttgcctgtgcgctgtttcaacacggcgatgcgggcctcggccggtatcgatagtccgttgccgttatcctcaccaccgtaaagtgatactcccaatatgagttgcggtttttcggagaggccgtttttgatttccctccgggctggcgggtgttcaatgtcggttccggttttgtcggttgcgtggtgggtgacaataatggtggatcctgtgtctcgaccgagggctgtgatccattgcatggcttcctgctgggcctggtagtcggattcgcagtcttgaatgtccatcaggttgtcgataacaatgatggggggaaagtggttccacatttccatgtaggcttgcaactccatggtgatgtctgtccatgtgatgggtgactggaatgagaatgtgatgtgttggccgtggtggatgctgtctcggtagtattctggcccgtagttgtcgatgttgtgttgtatctgggcggtggtgtgttgggtgttgagtgagatgattcgtgtggaggcctcccagggtgtcatgtcccctgatatgtagagggcgggctggttgagcattgcggtgatgaacattgctagcccggatttttggctgccggagcgccccgcaatcatgacgagatcccctttgtggatgtgcatgtccaggttgcggtagaggggttctagttgtggtatgcggggcagctcagctgcggtttgggaggctctctcgaaggatcgttgtagagagagcatcggagcctttatctatctgttacggttgaaggatatatgggtggtcagatggagtcgatgtctacatcgtcgcttccgccagtgttgggtttgctgtctcgcttgtcaacgtaggctgctacgaggtcgtagatggcatcatctaatggtttgaggatgacggcgttgaaaccgtttttggtgcgcactgtggcgagtttgaaggcctgctcctcgccaaggtaggtttcgagttcgcggatcatggagtgtgggcgatcattgttgccgcgcgctttctcaataatagcgttggggatggtttctggggtgccgttgttgagatcctggagtgtgtggaagatagtaacgtcggcgtaaatacggtctgcgacctgtccgccgtatccttcggtgttgtgctcgacgtcgtggactttgaaggcgatggcggtggcgtcctggtttttggaggggttgaagaaggtgctgtcgttgttgttgcggtagtttgcgagtcccattgttgtttcctttactgttttgttggtttgtgtcggtttttatcgggtgaggctgtttcgtttgctgcggaacgcctctgacacgtcggggttactggtgatggtctttttgtactgtttgagtagatcggctagctgtgccttgctggtggctttgttgattttgtcgatgacgatgtcgttttcttgggatgtgatgttgtctacatagtttttggctgcctggttgtatcggtcttggagaatgattgatgcggaggctgtgagggttgccaaatcccagtctttggacacgtcatcgtttttgaggcctccgaggaggtcgatgatggcctgtttggcctgattggctgtgtctcctcggattacagcccacggtgcggcatagtctccaccgtatttgagtgtgatggtgatgcgatcatcaccggtgttggtgtcggtcactggttctccttgccttcctcgagtggtgtgatggtggtttggatcgggtacctgtaggcgtctttcccgtctatagcccagcaggcgtcccgtacggggcatcctttacacagggctgtgacgtgtggaacgaagatgccttgactgattcctttcattgcttgactgtacatggatgatacatgccggtgggtgttgttgtcaagatcgtagagttcggtggctgtgccctgctcgactgatagctgatcattcttagtggtggcgggtgtccaaaacatgcctttcgtcacatggatgccccgctgttcgagcatgtaccggtatgtgtgcaactgcatagcatcgactggcaggcgacccgttttgaggtcgaggataaacgtttcgccggtgtctgtgtcggtgaagacacggtcgatgtagccgacaatctttgtgccatcctggagggcggtttctaccgggtattcgattcctggtttaccgtctaggattgcggtgatgtattctgggtggtttcgcctccatgttttccagcggtcgacgaagatggggccatagtgcatccaccaatcatagtttttcttgttgggtcctccgctttcgcacatgtttttgcacactctgccagagggtttaatctcagtgccctcggactgagcgaaggctacctgtgtgtcgaaaacattgttgaaggatagaaggttgtcgggtatttcgggatattctgcagggttgtgcaggtggaggtcgtattgttcggtgatgtggtggatcgcactgccggcgatggtggcataccaggtgtgataggtggccttgtagccgtgggagaggcgccatttttctccacattcggcccactgcgatagggagctgtaggagatgtggcctgggtggttgatggttttcgggtattgtgctagaggcattacttgtcgcttttattccatgggttgcgggtgtcttggccggcgtcatgctgctggtatgcgaggagtgtcaggcagtgccaggcggcatgtgccagatgcggcaggtgtgattcatcgtcgagattgtttccttgctgccaggctagcaggtgcctgtagagggcgtcaatactgtgacaccaggggtatcctccggtccagttgttgtctccgtatttggtggcaccgtatccggcaacctcacctaaagcatggagggatgcggggtcgatgagggagagccggcatagtttgagttcttttcgggcgcccgtgttggggtcggtgtacatgcgggtgggctcatccatggggtgtgtgctccttaagggtgggttactggtttttgtcgtgggcgagtgctacggcgagaataatgatggcgagggtttcagcgatcaggatgggtgttgtgatcatttgtggtctttgggctggtaggtgagtgttgatgcacccaggagggtggctagggcgcatgcggcaatgatggcgagggcggctttgtggctggtgcctgttgcgtacatccatgtgataataccgccttggatccaggccaggctggtgaagaacgtttcgtagctgtgcaactcgatacggttgggtgtgttcatgcttgctcctgaagaatggtgttgatggttttataaatgttgtacaggtcggtttcgatagataacagttggtggatttcgtggtcgagattgatgtctgggttgagggtgttgatgcgggatgcaatatcggtggctgtgcgtagtgtgccgccggtgtggtgaataatgtgtgccgtgtcggcgagtccggtggtgacagcgtagtgggagaggagaggcatagcggggatgctccttggctggttactgttgcgggttgatgttgaggtcggtgacgttggggtggtcttctgttcctgtgatgaggcagtggacggtgacgggtagtttggatgcgccgggctgtttcatggttgcgccgtagacgatgctgaacgtgtctttgccaataattttgtggagttgtaggtcgatgtcggggttgccgttccatttgataccgtgtgcggcggccttctgctcagccttgtcattgcaggtgtgggctgccgtaatcatggtgagtccggttgcggtttcttcaccccttgcttgggcttgcttgtgggttttgtcctgctcggcttgtagggatcgggtggcttcagcctgcttggcggctttctcggctttgcgctgctgggcggtttcaggtgtccatgcagtgtttgctgtggtgacctgtggggccggctgtgatgcgagtggcgggttgtcgtcgggggctggtaggaaggaggctgcggcaataatggcggctgtgattccagcgatggtgtagccgtttttcttgttcatgattttgtattcccctttccggggtgttgttcgttgctgacatgattgatacttccagactggactatgactgtcaaagtgtcgctcagtttgtgtgagcgatccttgtggggtgagggggttttatcgggcgaacagagttaacaggtggccgatgttgatgcggctcacattccagtagagttgtgtggcttcaccgctggtgagcggcttccacgtgtcatggctgtacacggtaccgtcggatgcgatgaatgtgttggggcgtagcttgtgaagttcagtctctacgctctgccggtaggcttcggcgaggccctcaaaatccaggtggtcgcaggcgaggttttcaaggcgtgtcaggtcgaaaggtgtggggcagtcgtagctggcgggggcgtagagctgggtgaaatggtttgcgatcttttgcatcatgattccttttctcgtgtgatgggttgatagttttatcgtgtagcttcggcgaggatgacgtctacatcgatcacgtcgatcatgtcgtggagttcctcagcttcgtcctcagataggtggcgccagtcgtagtcgccgtacacggcgccgtcgagggtgacagtccacaggggccggatgagccgtatggcttcttcgactttggcgtggtacatgcggcgcaccctatccagatccatgtcgtctgactggtttccggtgaggctgtggaggctgagtgggttgatttctgtctgcccgtagaggctggtgaaggatggtgtgatgagtgtgccatccatgaggggatgctcctttcggtggtggaggggttgttgtggtttctagagtgtgcgggctgcgactccatagtcaaggtggcactcattcggattgagcgtttcatgctggagtgttgggtgtgacagatgtcacttgagcctttattgcctctctcggcgtctcaaatcttctgggggtaggattatgcagggttgaccctgctagtcgattctagggcccttctagggcgtctcaagggtatgtctgggttgtagcgagtgttgcagatgatctagcaggtcgagataggtctgtctcgcaggggtgggggtgccctaattgggcatggcatctaatccccagagtgtgtgagataggccacatctccctagcttgatacgtatcctcgaagctactctgccgatctggcgtagagggtgtagcccagaaatgccgtttaaagcatcagcatggcgcccaggagcgccttacagggtgggggctaggtatttatacccccagcacattctgatcgattctagacgcataccggagccttgtgcgagatcagctctccggacgcagatcatcagcccctatcctgcttagctaagcctgcactatgtggacagcgtgggatgctaaggggggaaggacacggtaaaaagaagaggggggagcatcagccttcacgtcttaggtactgaagttcaccttagggtcttagcacttagcaccgagccccttgaggggctcggcatcagcccgagccggctcagctcatcaggcacagccctgaaaagggtacacgccatcaggggaagtcttgagagtacgaggagcctcagcgacgagtactcgaaagcctgagggaacaccctgagcgctgatgggcctagcgtgttcggaaaagacacaagagtgaagtgtgacagctgtccgggagtgaaacccgttctggctaggggttttagtcttaaacacccgtaaaggttacaagactctaagaaaatttaaggaaaagtttaggttttatttttggacctttactaccaaaaacacccgtttacaccccctcaaacccgccaatagagccaaacagtcatgtttggctcatcccaggtggcgtatgctaggctggacaggtagccagctggacgcaaggccgaaatccgctgacgcggctttcacccttacatccatcagtctacaaaacacttaaagaccttaagagctaagcgctcaggtgctgatagcttagcaccgagcccctcaagggctcggcatcagtcttaggtactttagataactttaaaacattcaaggcttagcccttaaagttataaataaactttaaagctttaaagtcttaaagtacatataaaaccttaagacttaaacagctaagttaactataaggccttaaagacttagcacttaaggatataaacttaacatcagtatttataacttataagccttaatactttaaataactataagatcttaaaggcttaaacacttaaagtaactagaagactttaaaatcttaagtacttaaagttaaccatcagtcttaaactttaatactataacctataagtcttaaagcttataggtataataatataactatataagtattaaggcttataagttataaaagttttagaagagctaaggggttaacttctttacttctctactctctttggtactttctctcttctcttcttttcttcatcaggggagaaggggaacctttaccatcaacgccgatgggcttttcgccgtgtgactcgtgtgcttggtcgcaagctcccatcgcacactccccacactcttacacccgtatccctttacagctttgtgtgttcggctgaaggcgtacggcgtgtcacgcttaaacccttaacacccggtaagacttaaagtgtatattatatgtagaagattttaaaaactttaagggtgtacacgttttggctgtgtcctacaccgctaggcgctaagcctggaagtgctaacacacactcacccccatttttcttccgtgttcttctctttttgacacagctggggggcgatgtgatctttctcacacccgtgggggtagtggagaaaacaaacaccccgccacgatcacaacaccccctcaaactaacaaaacagcccccagaatcgaacagcagggcaatggcaaggtattcatacccccaacggtttccaagtcctcagagaggcaatgagagcccatagaggcgtggtagacgatcgggaggcgatatggcacacaccaaccgcaccgcatcctccgcacaccggcgctggcggcaacaactcatcaccaaagcccgacaacaaggccaaaccgaatgccccttatgtggagtcaccctcacctgggacacccaccagctgccaaccagccccgaagccgaccacatcacacccgtcagccggggaggactcaacaccctagacaacgggcaaatcatctgcagaacatgcaacagaagcaaaggcaacagaacacaaccaaacatcaaactccaacaacaaaccacaaaaacactcgtcatctggtaaaaaacccgccaacccccaccggggacaccccctgcacaggcgtgcaagacc

SEQ ID NO: 38 - DNA, 29511 bp, Unknown
  source: /note="Description of Unknown: Bacteriophage of P. acnes"
agtgaaatacctcccctttgttgttttatcgttttgtcgactttttgtttggtggtgatggtggtgcagcctgagcttcccgagtctcgtgagtggtgtgaggagacgcgtcgttggtggcgtgtgtggggtgaggatgcgcgtgctgggtttgtgtctgatgaggagtggctgtttctcatggatgctgcggtgattcatgatgtggtgtggcgtgagggtcgcgcggaccttgtggcttcgcttcgtgctcatgtgaaggcgtttatgggcatgttggatcggtattcggttgatgtggcgtctggtggtagtggcgggggttctgcggtggcgatgattgacaggtatcggaagcgcaagggggcctgattaggtgtctggtgtggttggttctcaggttcctcgtcatcgtgtggcggcggcgtattcggtgtctgctggtggggatgctggtgagcttggtagggcgtatgggttgtcgcctgatccgtggcagcagcaggtgttggatgattggcttgctgttgggacgaatggccgtttggcgtctggtgtgtgtggggtgtttgtgcctcggcagaatggcaagaatgctattttggagattgtggagttgtttaaggcgactattcagggtcgccggattttgcatacggctcacgagttgaagtcggctcgtaaggcgtttatgcggcttcgatcgttttttgagaatgagcggcagtttcctgacttgtatcgtatggtgaagtcgattcgtgcaacgaatggtcaggaggctattgtgttgcatcatccggattgtgccacgtttgagcgtaagtgtggctgtccgggttggggttcggttgagtttgtggctcgtagccgggggtctgctcgcgggtttaccgttgatgatttggtgtgtgatgaggctcaggagttgtcggatgagcagttggaggctttgcttcctacagtgagcgctgccccgtctggggatcctcagcagatttttttgggtaccccgccggggccattggctgatgggtctgtggtgttacgtttgcgtgggcaggcgcttggtggcggtaaacgtatcgcgtggactgagttttcgattccggacgagacggatccggaggatttgtctcggtcgtggcggaagcttgctggggatactaatcctgcgcttggtaggcgtctgaattttggtaccgtgtctgatgagcatgagtctatgtctgctgccgggtttgctcgtgagaggcttggttggtgggatcgtggccagtctgctgtgtcggtgattcctgccgataagtgggcgctatcggcggttgatgaggtgcatctttctggtgggaaagtgtttggggtttcgttttctcgttctggtaatagggttgctttggcgggtgctggcagggcggatgctggggttcatgttgaggttattgatggcttgtcggggacgattgttgatggtgtaggccaactggctgattggctggcgttgcgttggggtgacacggaaaagattatggttgccggttctggtgcggtgcttttacagaaggctttgactgatcgtggtgtgccgggtcggggcgtgattgtggccgataccggtgtttatgttgaggcgtgccaagcttttctggagggtgtgcgttcgggtgttgtttctcatccccgtgctgattctcgccgtgacatgttggagattgctgtgaggtcggcggttcagaagcgtaagggatctgcttggggctggggctcgacgtttaaagacggcagtgaggttcctttggaggctgtgtcgctggcgtatcttggtgtgaagatggcgaaggctaagcggcgtgagcgtagtggtaggaagcgggtgtctgtggtatgaacgtggacgagttggctcttattgagggcatgtacgatcgtattaagaggttgtcttcgtggcattgccgtattgagggctactatgagggttcgaatcgtgtccgtgatttgggggttgctattcctcctgagttgcagcgtgtgcagacggtggtgtcgtggcctgggatagcggtggatgctttggaggagcgtctggattggcttggctggactaatggtgacggctacggtttggatggtgtgtattctgcgaatcggcttgctacggcgtcgtgtgatgtgcatttggatgcgctgatttttggtttgtcgtttgtggctgttattccccaagaggatgggtcggtgttggttcgtccgcagtcaccaaagaattgcaccggaaagttttcggctgacgggtcgcgtcttgatgctggcctggtggtgcagcagacgtgtgatcctgaggttgttgaggcggagcttttgcttcctgatgtgattgttcaggttgagcggcgggggtctcgtgagtgggtcgaggtgggccgtataccgaatgtgttgggtgcggttcctttggtgccgattgtgaatcggcgcaggacgtctcgtattgatgggcgctccgagattacgaggtctattcgtgcttacacggatgaagcggttcgcacgctgcttgggcagtctgtgaatcgtgatttctatgcttacccgcagcgctgggttacgggtgtttctgcggacgagttttctcagcctggctgggtgttgtctatggcttctgtgtgggctgtggataaggacgatgacggtgatactccgaatgttgggtcgtttcctgttaatagtcctaccccttattctgatcagatgcggctattagcccagttgactgctggggaggctgcggtgcctgagcgctatttcgggtttatcacgtctaacccgccgtcgggtgaggcgcttgcggcggaggagtctcgactggttaagcgtgctgagcggcgtcaaacatcgtttggtcagggctggctgtcggttggttttctggctgcgaaggcgttggattctcgcgtggatgaggctgcttttttcggtgatgtgggtttgaggtggcgtgacgcgtcaaccccgactcgggcggctacggcggatgctgtgacgaagcttgtgggtgccggtattttgcctgctgattctcggacggtgttggagatgttgggtttggatgatgtgcaggttgaggctgtgatgcggcatcgcgccgaatctgcggatccgttggctgcgttggctggggctatttctcgtcaaactggcgaggtttgatggatggcttcgggtgtgatgtcgaggctggcggcgactgagtatcagcgtgaggcggtccggtttgccgggaagtatgcgggctattatgccgagcttggtcgtttgtggcattccggaaaaatgagtgacacgcagtatgtgcgtttgtgtgtcgagttggagcgtgccggccatgatggttcggcgtcgttggcggcaaggtttgtgtcggattttcgccggttgaatggtgtggatcctggtttgattgtgtatgacgagtttgatgctgctgctgcgttggcccggtcgattgcgaccacgaagattttgaagggtgatccggatagggcgaatgatactattgatgcgatggcggcgggttttgatcgggctgtgttgaatgctggccgtgacacggttgagtggtcggcgggtgcgcagggccggtcgtggcgtcgtgtcacggatggtgatccgtgtgctttttgtgcgatgcttgcaaccaggtcggattatacgactcgggagcgtgcgctaaccgtggggcatactcggcgtcataggcggggtggtaagcgtccgctgggttcgaagtatcatgatcattgtgggtgtacggtggttgaggttgttgggcgttgggagcccagttccgcggacaccgcatatcagcgggtttatgagaaggctcgtgagtgggttgatgatcatgggttgcagcagtcgcctggcaatattttgaaggctatgcgtactgttggcgatatgagatgattgatatggtttccggttgtgcgccgccggttatcggtgcacgtggttgtctcccgcacggggggcggcaagattgtgttgttttccgcaaggagtgtagggttaggctatggccgatcagaatgttgaagaacaaaacgtcgacaaagtagaagaggttcccgaaaagggtgacgttgttgacgtcgtaaaggatgatcaaagcgggcagacaggcgatcagtcgaagcatgatggtggagataagccgtctgggactgattggaaggctgaggctcgtaagtgggagtctcgtgctaaaagtaatttcgccgagttggagaagcttcgcgcctcggatggtgatgcggggtctactattgatgagcttcgccgtaagaatgaggagctcgaagaccggattaatgggtttgttcttgagggtgtgaagcgcgaggtggctgccgagtgtggcctttcggccgatgcggtagcttttctgtctggcggtgatcgcgagtcgcttgccgagtctgctaaagcccttaaggggctgattgaccatagtggtagtggtggcgcgggtgtgcgccgtcttgcggggagtgcccccgtggatgatgttaaacgacgtgagggtgtcgcgtttgtggatgctcttgtcaataattctaggagatgatttatcatggctgacgattttctttctgcagggaagcttgagcttcctggttctatgattggtgcggtgcgtgaccgtgctatcgattctggtgttttggcgaagctttcgccggagcagccgactattttcggacctgtgaagggtgccgtgttttcgggtgttcctcgcgccaagattgttggtgagggcgaggttaagccttccgctagcgttgatgtttccgcgtttactgcgcagcctatcaaggttgtgactcagcagcgtgtctcggacgagtttatgtgggctgacgccgattaccgtctgggtgtgcttcaggatctgatttcgcctgctctgggtgcttctattggtcgcgctgtggatcttattgctttccatggtgttgatccggctacaggtaagccggctgctgctgttaaggtgtcgctggataagacgtcgaagacggttgatgccacggattctgccacgaccgatctggtcaaagcggtagggctgattgcgggtgctggtttgcaggttcctaacggtgtcgccctggatccggcgttctcgtttgcgctgtctaccgaggtgtacccgaaggggtctccgcttgccggtcagccgatgtatcctgccgccggtttcgctgggcttgataattggcgtggacttaatgttggtgcttcttcgactgtttcgggtgccccggagatgtcgcctgcctcgggtgttaaggctattgttggtgatttctctcgtgttcattgggggttccagcgtaacttcccgatcgagctgatcgagtatggcgatccggatcagactgggcgtgatcttaagggccataatgaggttatggttcgtgctgaggctgtgctgtatgtggctatcgagtctctggattcgtttgctgttgtgaaggagaaggctgcaccgaagcctaatcctccggccggtaactgatttattgtagcggtgatatgtatatgtgcagggggtggtgttgatgggtatcattttgaggcctgaggatattgagcctttcgccgatattcctaaagataagcttgaggcgatgatcgctgatgtggaggctgttgctgtcagtgtcgccccctgtatcgctaaaccggacttcaaatacaaggatgctgccaaggctattctgcgtcgtgctttgttgcgctggaatgatactggcgtgtcggggcaggtgcagtacgagtctgcgggaccgtttgcccagactacacggtctaatacgcctacgaatttgttgtggccttctgagattgctgcgttgaagaagctgtgtgagggtgacggtggggctggtaaagcgttcacgatcacacccacgatccgtggcggatatgcacattctgaggtgtgttctactgtgtggggtgagggctgttcgtgcgggtcgaatattaacggctacgctggccctttgtgggagatatgatatgattaattttccttacggtgaaacggttgtgatgcttcagccgactgttcgtgtcgatgatcttggcgacagggttgaggattggggccatcctgtagaaaccgtgtaccataatgtggccatctatgcttctgtgtcacaggaggatgaggctgccggccgtgacactgattgggagcattggtcgatgctgttcaagcagcctgtcaagggtgccgattatcggtgtcgttggcgtattcggggtgttgtgtgggaggctgacgggtctcctatggtgtggcatcacccaatgtctggctgggatgctggtacgcaggttaatgtgaagcgtaaaaagggctgatggttgtggcacgtgatgtgaatgtgaagcttaacttgccgggtattcgtgaggtgttgaagtcttctggggtgcagggcatgttggctgagcgtggcgagagggtcaagcatgcggcctctgctaatgtgggtggtaatgcttttgataaggcccagtatcgtgccgggttgtcgtctgaggtgcaggttcaccgtgttgaggctgtggctaggattggcaccacctataagggtggtaagcgtattgaggcgaagcatggcacgttggctaggtcgattggggctgcgtcgtgatcgtttacggtgatcctcgtgtgtgggctaaacgtgtgctcaaggatgatggctggctgtctgatataccgtgcacgggtactgtgccggatcaatttgagggtgacctgatttggcttgcgttggatggtggcccccagttgcatgttcgtgagcgtgtttttcttcgcgtgaatgtgttttcggatattccggatcgtgctatgtcgttggcgcgtcgtgttgaggctgtgctggctgatggtgttgatggtgatccggtggtgttttgtaggcgttctactggtcctgatttgttggttgatggtgcacgttttgatgtgtattcgctgtttgagctagtgtgccgtcctgtcgaatccgagtaaacgtatttgttttctatattttgtttttgtttgattatttttgggggttgtgatggctgctacacgtaaagcgtctaatgttcgctctgctgttaccggtgacgtctatattggtgccgctcacgccggtgacactattgatggtgttgggaagattcctgacggtcttaccgctttagggtacctgtcggatgacgggtttaagattaagcctgagcgtaaaacggatgatttgaaggcttggcagaatgcggatgttgttcgcaccgtggctacagagtcgtctatcgagatttctttccagctgatcgagtccaagaaggaggttatcgaactgttttggcagtcgaaggttactgccggagtcgattcgggttcgttcgatatttctcctggtgctacgaccggtgttcatgccctgttgatggatattgttgatggcgatcaggttatccgctactatttccctgaagctgagcttgtcgatcgtgacgagatcaagggtaagaatggcgaggtgtatgggtatggtgtcacactgaaggcgtatcctgcccagattaataagaagggtgatgcggtgtctggtcgggggtggatgacggctttaaaagctgatactcctccggttcctccgaagcctccgaagcctgagccggatcctaatccgccagccgagaactgatacatatttttgagggattgttgatagatgagtgacacaggtttcacgttgaagattggtgaccgtagttgggtgttggctgatgcagaggagacggcgcaggctgttcctgcccgtgtttttcgccgtgccgctaagattgcccagtcgggggagtctgctgatttcgcccaggttgaggtgatgttttctatgttggaggctgccgccccagcggatgctgtagaagcgcttgagggcttgcctatggtgcgtgttgccgagattttccgtgagtggatggaatacaagcctgacggtaagggtgcctctttgggggaatagtttggctccacggcctgattgatgattatcgtggggccatcgaatatgattggaggacccggttcggttgctctgtttatgatgttggtggcccggtgatgtgttggggtgaggctgtccggctggctggcgtgttgtgtactgatacgtcgagccagttggcagcccatctgaatggttggcagcgcccgtttgaatggtcggagtgggcggtgttggatatgttggatcattacaggtctgctaatagtgaggggcagccggagcctgtggcgaggccgacggatgagcgtcgggctaggtttacgtcgtctcaggtggacgatattttggcgcgtgttcgtgtcggtggcggggtgtctcgcgagattaatattatggggtgaatagtgtatgtctggtgagattgcttccgcctatgtgtcgttgtatacgaagatgcccggtttgaaggctgatgttggtaaacagttgtcgggtgtgatgcctgctgagggtcagcgttcgggtagtctttttgcttccggtatgaagttggctttgggtggcgcggcgatgatgggtgccatcaatgttgccaagaagggcctgaaatcgatttatgatgtgactattggtggcggtattgctagggcgatggctatcgatgaggctcaggctaaactgactggtttgggtcacacgtcttctgacacgtcttcgattatgaattcggctattgaagctgttactggtacgtcgtatgcgctgggtgatgcggcttctactgcggctgctttgtctgcttctggtgtgaagtctggcgggcagatgactgacgtgttgaagactgtcgccgatgtgtcttatatttctggcaagtcgtttcaggatacgggcgctattttcacgtcggttatggctcgcggcaagctgcagggcgatgacatgttgcagcttactatggctggtgttccggtgttgtctttgcttgcgaagcagacgggtaaaacgtcggctgaggtgtcgcagatggtgtcgaaggggcagattgattttgccacgtttgcggctgcgatgaagcttggcatgggtggtgctgctcaggcgtctggtcagacgtttgagggcgctatgaagaatgttaagggcgctttgggctatcttggtgctacggctatggccccgtttttgaatgggttgcggcagatttttgttgcgttgaatccggttatcaagtcggtcacggattctgtgaagcccctgtttgcgtcggtggatcaggggattcagcgggtgatgccgtctattttggcgtggattaatcgtatgccgggcatgattacgagaatgaatgcacagatgcgcgccaaggtggagcagttgaagggcatttttgcgagaatgcatttgcctgtccctaaggtgaatttgggtgccatgtttgctggcggcaccgcagtgtttggtattgtggctgccggtgtggggaagcttgttgcggggtttgccccgttggcggtgtcgttgaagaatttgttgccgtcgtttggtgctttgaagggtgccgctggcgggcttggcggcgtgttccgtgccctgggtggccctgtcgggattgtgatcggcttgtttgctgccatgtttgcgacgaatgtccagttccgtgcctctgtgatgcagcttgtgggtgttgtcggtcaggcgttggggcagattatggctgctgtgcagccgctgtttggtttggttgcgggtgttgtggcccagttggcgccagtgtttggccagattattggtttggtggctggtttggctgcccagctggtgcctttgattagtatgcttgtcgcccggctagttcctgtgatcacgcagattattggtgcggtgacacaggttgcggccatgctgctgccagcactgatgccggtgttgcaggctgttatggctgtgatacggcaggttgttggcgtgatcatgcagcttgtgccggttttgatgcctgtgattcaacagattttgggtgctgtgatgtctgttctgccgcctattattggtttgatacggtcgctgataccagtcatcatgtcgattatgcgtgtagtgatgcaggttgttggtgccgtgttacaggtggtggcccgtattattccggttgtggctccggttgttggggctgtgatagggtttgttgcacgtattcttggcgctattgtgtctgccgcagcccgcattattggcgctgtaacccgtgttatcggatgggttgtgagccatctggtgtctggtgtggcgcgtatgggtacggccatcctgaatggctggaatcatattagggctttcacgtctgcgtttattaacggtttcaagtcgatcatttcgggcggcgtgaatgctgttgtggggttttttgcccggcttggttcttcggtggctagccatgttcggtctgggtttaacgcggcccgtggtgctgtttcttccgcaatgaatgctatccgtagtgtggtgtcttcggtggcgtctgctgttggcgggttcttcgggtcgatggcgtctagggttcgtagtggtgctgcgaggggctttaatggggccaggagtgcggcttctagcgctatgcacgctatgggttctgcagtgtctagcggtgtgcatagtgtgttggggttttttcggaatctgcccggtaatattaggcgtgctctcggtaatatgggatccttgttggtgtcggctggccgtgacgtggtttctggtttaggtaatggtatcaagaatgctttgagtggcctgctggatacggtgcgtaacatgggttctcaggtggctaacgcggctaaatcggtgttgggtattcattccccgtctagggtgtttcgtgatcaggttggccgccaggttgttgccggtttggctgaggggatcaccgggaatgctggtttggcgttggatgcgatgtcgggtgtggctggccgtcttccggatgctgtggatgcccggtttggtgtgcgatcgtctgtgggctcgtttacaccgtatggcaggtatcagcgtgcgagcgagaagagtgttgtggtgaatgttaacggcccgacgtatggtgatcctaatgagtttgcgaagcggattgagcggcaacagcgtgacgcgttgaacgcgttggcttacgtgtgagtgggggtgttgtgcatgtttattcctaacccgtctgatcgtgccggtttgactgttacctggtctatgttgccgttgattggtaatgatccggagcgtgtgcttcatttgacggattatacgggtgcgtctcctgtcatgttgttgaatgattcgttgcgtggtttgggtgttcctgaggtggagcatttttctcaaactcatgttggggtgcacgggtctgagtggcgcgggtttaatgtgaagcctcgcgaggtgacgttgcctgttttggtttcgggtgttgacccggatcctgcgggcgggtttcgtgacggttttttgaaagcctatgacgagttgtggtctgcgtttcccccgggcgaggtgggggagttgtctgtgaagactcctgccggtgttgagcgtgtgctaaggtgtcggtttgattcggtggatgacacgtttacggttgatccggtgaatcgtggctatgcccgctatgtgcttcatttgatagcctatgacccgttttggtatggggatgagcaaaagtttcgtttcagtaacgcgaagttgcaggattggttgggtggcggccctgtaggcaaaaacgggactgcgtttccggtggtgttgacgcctggtgttggttcgggttgggataacctgtctaataagggtgatgtgcctgcgtggcctgtgattcgtgttgaggggcctttggattcgtggtctgtgcagattgatggtttgcgtgtgtcatcagactatccggttgaggagtttgattggatcacgattgatacggatcctcgcaaacagtctgcattgttgaacgggtttgaggatgtgatggatcgtttgaaggagtgggagtttgctcctatcccgccaggcggttctaagagtgtgaatattgagatggttggtttgggtgccattgttgtgtcggtgcagtacaggtttttgagggcttggtgaatagttgatggctggtcttgtcccgcagataacattgtttacgccagactatcgtcgtgtggcgcctatcaatttttttgagtcgctaaagttgtcgttgaagtggaatggtttgtcgacgctggagttggtggtgtcgggggatcattccaggcttgacgcgttgacgaagccgggtgcacgccttgttgtcgattatggtggtggccagattttttctgggcctgtgcgtaaagtgcatggtgtgggtccttggcggtcttcgagggtgactatcacgtgtgaggatgatattcggctgttgtggcgtatgttgatgtggcctgtgaattatcgtcccggtttggtgggttcggagtggcgtgccgaccgtggttatgcccactattcgggtgcggcggagtcggttgctaagcaggtgttgggggataatgcgtggcgttttccgccaggtttatttatgaccgatgatgagcgtcgtggccgctatattaaggattttcaggtgcggtttcacgtgtttgccgataaattgttgccggtgttgtcgtgggctcggatgactgtttcggtgaatcagtttgaggataaggtgaatgatcagcggggtttagtgtttgattgtgtgcccgcggtgacgcgtagccatgtgttgactgccgagtcgggttcgattgtgtcgtgggagtatgtgcgtgacgcccctaaggctacgtcggtggttgttggtggccgcggcgagggcaaggatcggctgttttgtgaggatgttgattcgatggctgagggggattggtttgatcgtgtcgaggtgtttaaggatgcccgtaacacggattctgagaaggtgtctctcttcgatgaggctgagcgggtgttgttcgagttaggggccacgtcggggtttaagatcgagttggccgagtcggatgtgttgcgttttgggcccggcaagctgatgcccggggatttgatttatgtggatgtgggttctggccctattgcggagattgttcggcagattgatgtggagtgtgattcgcctggtgacggctggacgaaggtgactcctgttgcgggggattatgaggataatccgtctgccctgttggctcgccgtgtggctggtttggctgcaggtgtgcgggatttgcaaaagttttaaaagtgatgggggtttgttgtgggtattgtgtgtaaagggtttgatggtgtgttgaccgagtatgattgggctcaaatgtctggtctgatgggtaatatgccgtcggttaaggggcctgacgattttcgtgtcggcactacggttcagggtgccacggtgttgtgtgaggttttgccggggcaggcttgggctcacggggtgatgtgcacgtcgaatagtgtggagacggtgacggggcagctgcctggtcctggtgagactcgctacgattatgtggtgttgtctcgggattggcaggagaatacggccaagttggagattgttcctgggggtcgtgcggagcgtgcccgtgacgtgttgcgtgccgagcctggcgtgtttcatcagcagttgttggctactttggtggtgtcgtctaacgggttgcagcagcagttggataggcgtgccgtggcggctagggtggcgtttggggagtctgcagcctgtgatccgacacccatggagggggatcgtgtgatggttccttcgggggccgtgtgggctaatcatgctaacgagtggatgttgttgtctcccaggattgagacgggttcgaagtcgatcatgtttggcgggtctgctgtgtatgcttacacgatcccgtttgatcgccagttcagtagtccgcctgttgtggtggcgtctatggctacggcggctgggggtacgcagcagattgatgtgaaagcctacaatataactagcaaggattttggtttggcgtttatcacgaatgatgggtctaagccgaatggtgtgcccgctgttgcgaattggatagctgtgggcgtgtgaccgtgttgaggctgtggtggcggttggtgtgatgttggggggctgtggtgtcgtggtttactcctgcactggtggcctctatttgtaccgcgttggctactgttttgggttcggttcaggctgtcacatctaagtctaggaagcgtttgaggcgcctgtctgctcaggtggatgcgatggaagagtatacgtggggtgtgcggcgtgaggttcgccggtttaacgctggtcttcccgataatgtggatcctttggtgttgcctgatccgcccgggtttttgcaggatcagttggggggtgaatagatgagggagttggaggaggagaagcggcagcgccgtacttttgagaaggcttctatggtgttgttgtttctgtcgcttgtgctgttggcggtggttgctgggggtgctttgcgtttcggctctgtggtttcgcagagggattcggagcaggcgcgtgcggagtcgaatggtactgcggctaaagggttggctgcccgtgtgaagcaggtgtgcgcccagggtaggcaggagtcggtgcgtcttcaccggtctggcctgtgtgtggatgctgcccgtacggagcggagtgttcagggtgttcctggcccggctggtgagcgtggcccgcaaggccctgccggtgtggatggccgtgatggcagtaatggttcggctggtctggttggcccggttggcccgcagggttctcctggtttgaatggtgtgaaggggcctgacgggttgcccggtgctgacggcaaggatggccatggtggtgttccgggccgtgcaggtgatgacggtgtgaacggtgctgatggtcgggatggttcggccggtgaacgcggtgatgtgggcccttcaggttccgccggtccacagggtgaacggggtgagcgcggcccgcaaggccctgccggtgtcaacggatccgatggtaaagacggtaaggatgggcgtgatggccgctcggtggtgtctgtgtactgctcggagggccgcctgtttgtgaaatatagtgacggtgcgtcttctacagtgtcagggtctagggcgtgcccgggtgtggccccgtcgccgattgtgaccgtgtcatcccacaaatagtaagaggaagggtgttactagtgttgatgatgttttggggtggtgtgcggtgagatacattccagcggcacaccattcggctggttctaattctccggtgaatagggttgtgattcatgcgacgtgcccggatgtggggtttccgtccgcctcgcgtaagggtcgggcggtgtcgacggcgaactatttcgcgtccccatcgtctggtggctctgcccattatgtgtgtgatattggggagacggtgcagtgcctgtccgagtctactattgggtggcatgccccgcctaatccgcattctttgggtatagagatttgtgcggatggcggttcgcacgcctcgttccaggttccggggcacgcgtatacgcgggagcagtggctgtcgcctgaggtgtggcctgcggtggagcgggctgctgtcctgtgtaggcggttgtgtgaccggcatggtgttccgaaacggaagctgtccgtatcggatttgaaggccggcaagaggggtgtttgcgggcatgtggatgttacggatgcgtggcatcagtcggatcatgatgatccggggccgtggtttccgtgggacaggtttatggccgtagtctgcggccacgatagtggtagtgatagtggggagttaactgtggctgatgtgaaagcgctgcatgatcagattaaacaattgtctgcgcagcttactggttcggtgaacaagctgcaccacgatgttggtgtggtacaggtgcagaatggtgacttgggtaaacgtgtcgatgccctgtcgtgggtgaagaatccggtgacggggaagctgtggcgtacgaaggatgctttgtggagtgtctggtactatgtgttggagtgtcgcagccgcattagcaggcttgagtctgatatcaatagtttaaagaagtgatgtgtggtgggtaaacagttttggttgggcctgttagagcgcgccctgaaaacttttattcaaacgtttgttgctgtgcttggggtgactgcgggtgtcacctataccgcggagtcgtttcgtgggcttccgtgggagtcagctttgatcacagccacggtggctgctgtgctgtctatagcgacttcgtttggtagcccgtcgtttgtggccggtaaacccaaggttgctccggttgttgatgccggtcttgttccacccgatgataccggcctggtagaaccgcatgcggttgacgaaacggatcctggcatgatcgagccgatggatgatgataatgtggactatgtgccgaggcgtgcatccgagtctgaggttggcactgtagagccgtcagaatcataagtgaatatagtgtgtgccccagcggtgctgccacgtgtgtggtggctgctgctggggcactatttttgtgtctactgtatggctatgattcgttgttgtcgatggtggcttcgagcatctggtgcaggtgttcacactcggatatggtgtcacgggcttgatctaaaatgtctcgccggatcacgtttttgtggttgttgctgaggctgataagcgaacacatgatatcgtcggcggcggattgtagtagtttggcctggtatgcgattccggcgagccagtctatggcttccgggcttgcctgtgtgttgtctggcatgccactggtgttgctgttgtttgtggggtatcctgcactgtcgcagtcccacaggatttcgctgcactcgtctagcgtgtcttgatcgatgttgaggttgtcgaggctgacttctttgatggtgagatttacatcatctaaagagatgtggacgtggtattcgtcttgaatgtcggccacaatgttttccagctggttcatgttggtgggctgttgttggatgattcggtgtaccgctgttttgagggcagcgtgggggatattggttgtgttgttcatggttttatttcatccctgtactatcgtcgtctatgtatgatgttgtgttggcgtatttggtgagtgtgatcagtgtttggtctgcccactgtttcaccgtctgcctagtcacacccaatcgctgggctgccaccgaataggtttgatcatacccgtatacttccctgaatgcagccagccgtgccagccgtttcctctgtttggatggttcacaggtgagggtgtagtcgtcgatggctagctgtaggtcgatcatggtaacaatgttgttgccgtggtgttgtggagcggttggcgggggtggcatacctggctctactgatggtttccatggtccgccgttccagatccattgggcggcttgaatgatgtcggctgtggtgtaggtttggttcatgtgtcacccccggaacaggttgtcgaggttgtctaggttggggctggtgtttgtggtgtcgaatcgtcctacgcagtggcagtagtcgtacatgagtttaataatgtgttgatggtcaccaaggtaggtgttgccgctgatgctgtaggtggctgtgccgtctttgctgatggtgtatttggcggtgatagtttcgggtgtttcggtgttggtgatgatggcggtggtggtggtgcctactgtttggagtacggtggtttgggttccgtcgtcgagggttgtagtaaccataatgggggttctccttttagttgctggtttgattgtcggctatagtggtgatttcttgcaccggtttggggagatccaaatgctgtatggttttgttggctagccgtttggctaccctgtagcacattttggtgtagtgtttgttgtctaggttgtggtattgttctcgcaccgcaatatatagtagggagtcttggtacaggtcgtctgcgctgattgcggggtagtgttcggctattttggcgcatgcccggttgagtgtgcgtagatgatggtctgtggcccatccccacgatgctgtggtggccaggtctgcttttgttggtcgtctactcatgacactatttcatctcgctatctggtagttgtttggtgttttgttgttgatagtgtagcacacgagtccggggttgccggtggtgcctgtgcggtgccggtaccagacggattctccttccatggatgggcattgaataaaggtgcgttgtccttgctcggagatttctaggtggtgccggtgtcctgccatgaggatgtgggatgtggtgccgttgtggaattcttggcctcgccaccattcgtagtgttggttgttgcgccattggtggccgtgggcgtgaaggattttggtgcctgccacatcgacggtagtggtcatttcgtcccggctagggaagtggaagtgaaggttgggatattggttgttgagctggtaggcttctgcgatggcccggcagcagtccacgtcgaaggagtcatcgtaggtggtgacgcctttaccgaatcgtacggcttccccatggttgcctgggatggatgtgacggtgacgttggggcagtggtcgaacatgtggatgagttgcatcatggccatgcgggtgagcctgatttgttccgtcaagggtgtttgtgtgcgccaggcgttgttgcctccttgtgacacgtatccttcgatcatgtcgccgaggaaggcgatgtggacccggccgggtttgcctgcctgttgccagtagtgtttggcggctgtgagggatcgaagatagtcgtctgcgaagtgtgctgtttcaccctgagggatgcctttgccgatttggaagtcgcctgcccctaccacaaacgcacaatcactgttgttgctggtggtgtcggctggtttggggggctgccagtcggctagcttgtcgacgagttcatccacgggatacgggtctgttgcgggttggtggtcgatgattttttgtatggatcggcctgtttctccgttggggagtgtccattcggagatgcgtgtgcggcgtacggttccattggctagatcgtcgcagatggtgtctgcttcgtcattgtgctgggctagctgtgtgaggagccggtctatattgtctatcactggttttcctcctctttctgggtgttggtttgttggcggcgatagtctttgataacggtggcggagatggggtatcctgcctgggtgagctgtttcgctagccacgaggctgggatggttttgtctgcgagcacgtcggctgcttttgccccgtagcgttgaataagggtttcagttttggttgccatgatatcctatcggttgtgtggcgggctgccatcctgtgcggcagtcgccgtcgtgtcctggtttgcgtgtgcaccaggatatggttccgtctgtgtggttgagtgttttgccgcacatgacgttttgtagatgctctggcagtgcgccgtcaccctggttgctggtttgtgtgtcgaagagtgttttctggttagtgaaatgctcggatacggtcccgttgtggacgggtagtatccatgttttccattgctgctgtagcctggtgttccagtggaattgtttggccgcgttttctgcctgttttaaggttttgtagtagccaacgagtatgcgctggtgttgctggtcgggagggtttgggcctcgccagtattgtgcggccacggcgtagcggttgctggctgtgaaggtgttccagcagtattcgataatgttgttgagtgtgtcgtctgtgaagtcgtctgggttgtgttctgttgcctgggtgataatgccgcggatggcttgccggtttttggtggcgggtttgaacgagatgctcacgatagtaccggcttgtcgtcttgcatgaactggttgaaggtgttgttcccggcgtgttgggcttgtgtgatgtcctggtcggtccagtcggggtgttgctgtttcagatagtaccagtggcacgcattgtaggtttcgtcttgtagccgtgtgagatggttttcggtgatgatttgtttccacattgtccatgacacgtcgagccggttgaggatttcgagggctgggatgttgaattggttgaggaagaggatttcgtaggtgtagtagtttttctcgtattggtcccatccgcttcggtgcctgttgggctggtttttggggtaggcttcccggcatactttgtgtaaacgtttggccatgtcgtcgggtagtttaatgtcggggttggcgcggatcatggatcgcatcccatcataggtggtgccccaggtgtgcatgatgtaggtggggtcttcaccatcggcccatttttctgcacagatggcgaggcggatgcgcctcctggctgcttggctggtgttgcgccggttggtgatggggcacgtgtcgaggggatccatgatattttagtgtacctttcttggtttgggttgcttgtgtggttttattgtagcactgtgttgagggcttgtgtcaaccctgttttgccggttttcaggtaggtgtctgtgacatccccgagggtgaggggcacatgggtggcttggggaagtgctgtctggagagtttgggccatcttatctcccgcggggtcggggtcggaccagatgtaaacatggtcgtagccttcgaagaatttggtccaaaagttttgccacgaggttgcgccgggtatggcgacggcgggccatccgcattgttcgagtatcatggagtcgaattcgccttcacaaatgtgcatttctgctgccgggttggccatggcggccatgttgtagatggagcctgtatccccggccggggttaagtatttggggtggttgtgggttttgcagtcgtgttgtagtgagcagcggaaacgcatttttcttatttcggctggccgcccccaaacggggtacatgtaggggatggtgatgcactggttgtagtcttcgtggccggggatggggtcattgtcgatgtatccaaggtggtggtagcgggctgtttcttcgctgatgcctcttgccgagagaaggtcgagtatgttttcgaggtgggtttcgtagagggccgaggctttctggattcggcggcgttccgcaatgttgtatgggtgtagtgagtcgtacattcgggttttcttcttccaatcgttgttgtagcttggcgaggccgcctccaacaccgcatgtgtggcagtaccagacgcccttgtcgaggttgatgctcatggagggctggtggtcatcgtggagtgggcagaggatgtgttgctcgtttttggacgggttatagcggatgcgataggtgtcgaggaggcggcgggtgtcagaggtgtgggaggagctcgttgagggttgataccacataggcttcgctccatggcttgtttcgctgtttcatgatgactagtccgatggtggattggttttttttgttgcggtgggtttcatagttgcgtgcctcgattgtggcttctttcacgaattgggcgagatgctgctggccagccttggcttcgatcacataggttttgttgccggttttgaggatgaggtcgccttcgtcctctttgccgttgaggtggaggcgttctatatcgtagccggtgttgcgtagctggtgtaggagtctggtttcccactcggcaccggcccggcggttgcgtgactgttgtgaaaccatcatagtcctttatgttcttgtgtcatgttccatggctgtttttctaccaatggcccgaagaatgtgtattcggggtaggccctgagtctttcgtatcgggtgccgtctgggctagatttgccggtgcgctgtttcaacacagcaatgcgtgcctcggctggtatcgatagcccgttgccgttatcctcgccaccatacaatgagactccgaggatgagttgtggtttttcggagaggccgtttttgatctctcgtctggctggcgggtgttcgaggtcggtgccggttttgtcggtggcgtggtgtgtgacgatgatggtggagccagtatcccgacccaatgctgtgatccattgcatggcttcttgttgggcttggtagtcactctcgcagtcttggatgtccatcaggttgtcgatgacaataaggggtgggaaggtgttccacatttccatgtaggcttgtagttccatggtgatgtctgtccaggtgatgggtgactggaatgagaatgtgatgtgttggccgtggtggatgctgtctcgatagtattctggcccgtagtcgtcgatgttttgttgtatctgggtggtggtgtgttgggtgttgagtgagatgattcgtgtggaggcctcccagggtgtcatgtcacctgaaatatatagtgctggctggttgagcatggcggtgatgaacatggctagcccggatttttggctgccggaccgccccgcaatcatcaccaaatcccctttgtggatgtgcatgtccaggctgcggtagaggggttctagttgtggtatgcggggcagctcggctgctgtttgggaggctctctcgaaggatcgttgtagagagagcatcgggaccttatctatctatcggtggttgtgggtggtcagatggagtcgatatcgatatcagcctctgctgatgctgaagtgtcatctagctggccattatcgcgcttgtctacgtattcggcaaccttatcatagatggcgtcatcaaggggtttgagcacaaccgcgttgaacccgtttttggtgcgcacggtggcgagtttgaaggcctgctcctcgccaaggtatgcctctagatcgcggatcatggagtgtgggcggtcgttattgccgcgcgctttctcaataatagcgttggggatggtttctggggtgccgttgttgagatcgtctagggtgtggaagatggtgacgtcggcgtagatgcggtctgcgacctgtccgccgtagccttcagtgttgtgttcgacgtcgtggactttgaaggcgatggcggtggcatcctggtttttggacgggttgaagaaggtgctgctgttgttgtttcggtagttggcgagtcccataactgtatcctttactgtttgtgttgttttgttggtttgtgtcggtttttatcgggtgaggctgtttcgtttattcctgaaagcctctgacacgtccgggttgctggtgattgtctttttgtactgtttgaggaggtcggctagctgtgccttgcttgttgctttgttgattttgtcaataacgatggtgttttcttgggatgcgatgttgtctacatagtttttggctgcctggtcgtatcggtcttggagaatgatggaggcgctcgcgatcagtgttgccaaatcccagtctttagagacgtcgtcgtttttgagtcctcccagtaaatcaatgatggattgtttgatgtcttctgtggtgtctcctctgatgactgcccacggggcggcatagtctccaccgtatttgagtgtgatagtgatacgatcatccgtactgttggtgtcggtcactggttctccttatctttctcgagtggtgtgatggtggttttgatcgggtacctgtaggcgtccttgccgtctaccgcccagcaggcgtctcgtacggggcatcctttacacagggctgtgacgtgggggacgaagatgccttggcttattcctttcattgcttgactgtacatgcatgatacatgccggtaggtgttgttgtcaagatcgtacagttcggttgatgtgccctgctcgaccgattgctcgtatcccttggtggtggcgggtgtccaaaacatgcctttcgtcacctggatgccgtgttgggcgagcatgtaccggtaggtgtgcaactgcatagcatcgactgggatgcgcccggttttcaggtcgaggataaacgtttcgccggtgttggtgtcggtgaagatgcggtcgatatagccgacaatctgtgtgccgtcggcgagggtggtttcgactgggtattcgatgcctggctggccgtcaatggttgcggtgatgtattctgggtggtttcgcctccatgttttccaccggtcgacgaagatggggccatagtgtatccaccaatcatagtttttcttgttgggcccgcctgactcgcacatgtttttgcacaccctgccggagggtttaatctgggtgccctcttctttgaccagggcgatttgggtgtcgaacacattgttgaaggatgagagtttgtcgggcagtgcagggtattcgacggggttatacaggtggaggtcatgctgttcggttatgtggtgtatagcactgccggcgatggttgcataccaggtgtggtgttgggcatggtagccgtgggatagtcgccatttttcaccgcattcggcccactgtgtgagtgaactgtaggagatgtggcctggatgctggatggttttcggatattgtgctagaggcatgttagttgtttttgttccatgggttgcgggtgtcttggccggcctggtgttgctggtatgcgaggagtgtcaggcagtgccaggctgcatgggccagatgcggcagatgtgattcatagtcgaggttgtttccttgctgccaggctagtagatgtctgtagagggcgtcgatactgtgacaccaggggtatcctccggtccagttgttgtcgccgtatttggtggcgccgtatccggctacttcgccgagcgagtggagggatgcggggtcgatgagggagagcctgcatagtttcagttcttttttggcgccggtgttggggtcggtgtacatgcgggtgggctcatccatgagatgtgtgcgcctttcttgagtgggttactggttgttgtcgtgggctagggctacggcgagaatgatgatggcgagggtttcagcgatgatgatgggtgttgtgatcatttggtgtcgcggggatggtaggtgagggttgatgcgcctaggagggtggcgagggcgcaggctgcgatgattgcgagggctgctttgtggctagtgcctgttgcgtacatccatgtgatgatgccgccttggatccatgcgaggctggtgaagaatgtttcgtaactgtgcagctcaatgttgttgttgcgtgtgttcatgcttgttcctgaatgatggtgttgatggttttgtaaatgttgtacaggtctgtttcgatggtttttagctggctgatttggtggtcgaggttgatgttcgggttgagggtgttgatgcgggatgcgatgtcggtggctgtgcgtagtgtgccgccggtgtggtgaatgatgtgtgccgtgtcggcgaggccggtggtgacggcgtagtgggagaggagaggcatgataggtgtgctttctttctggtcagcgtgaagggttgatggacatgtcctcaacctgcggcttgtcttcggtaccggacacttggcagaaaaccttcacttgtgccttggatgccccgggttgctttgcggtggcaccgtaggcgatggagaaggtgtctttgtgggcgccgatgactttgtgtaggaagaggtcgatgtcggggtttccgttccagttgacaccttgcgctgcagccatctgggtggctttctgattgcaggcgtgtgctgccgtaatcatagtgagcccggtggaggtttcttcaccgcgggcttgcgcctgccgatgagccttggcctgctcggcttgtagggagcggactgcttctgcctgcttggctgtcttctcagccttgcgctgctgtgcggttttgggggtccattcggtgttggctgtggtggcctgtggggctggctgtgatgcgagtggcgggttgtcgtcgggggctggtaggaaggaggctgcggcgatgatggcgagggtggctccggcgatggtgtagcctgttttcttgttcatgaccgtgttcccctctcgtggggtttgttcgttgctgacatgattaatcattccatgggtggcatcggctgtcaagctgcgctcatttgggttgagcgttccttgtgtggctaggtgttttatcgggcgaatagggttaacaggtggccaacattgatgcgtgtcacattccagtagagttgtgtcgcctctgcctgtgtgagtggtttccactggttgtggctgtatacggttccgtcggtggcgatgaacgtgtcggggcgcatcttgtggagttcggcttccacatgctgccggtaggcttcggcgaggccctcaaaatccatatggtcgcagtggaggttttcgaggcgtgtcaggtcgaagggtgtggggcagtcgtagctggcggggctgtagagctgggtgaagtggtcggcgatcttttgcacgattattcctttccggtgatggtgtgttggttgtttgatcgtgtggcttcggcgatgatggcgtccacgtcgattgtgtcgatgatgtagtagagttcctcggcctcgtcctcggtgagtggctgccagttgcgtggcccgtatatggcgccgtcgagggtgacggtccattgtgggcggatgagccggatggcttcttcgactttggcacggtatagacgacagatgatagacgtctgggtgttgcctatgttgtgccctgttaggtgtgcggggtggagtgggttgatttctgtcggcccgtagagggttgtgaaggatggtgtgatgagtgttccatccacggtgggtgctcctttctggattgtttgggttgttgtggtttttatggtgtgatggttgcaaccgtgagtcaaggctgcgctcattcagcttgagcgtttcatgaggggtgtggtgtatatcactgaagcctttattgctcctgtaagcgtcttaaatggtctgggggtaggattatgcaggactaaccctgctagtcgattctagggcccttctagggcgtctcaggggtatgtctgggtgatggtaggtgttgtagatcattcggacgctcgaggttgtcatacatgacgatggttggggtgttctatctgggcataggttccactccctgtagtgtgtgagatagaccacatttccctagcctagtgtccatcaccaacaccccgcagctgatctggcgtggagggtgtagcccagaaatgccgtttaaagcttctagggtacacctaggagcgccttgcagggtgggggctaggtatttatacccccagcacattctgatcgattctagacgcctataagagctcgatacgtgatcagatcaccagacgcagaccatcctcccccatcctgcttagctaagcctacactatgtggacagtgtaggatactgtaggggaagaaagacacggtacaagaaagaagggggaggatccgccttaaagtcttagcacttaaggttttagcgcttagcaccgagccccctcaagggctcggcatcagcaccaccaggctcagctcatcaggcacagcctgaaagaggtacacgccatcagggaaggcttgagagtacgaggagccctagcgacgagtactcgaaagcctgagggaacacccttagtactgatgggcctagcgtgttcggaaaagacacacgagtcaagtgtgacagtccatcaggggtgaaacccgttctggctaggggtttcagccctaaccacccttaaaggttacaagagtctaagaaaatttaagaaaactcttaggaagaaagttgtgttcatgtccacccaaaaacagccaaaatagccctcaaacccgctaatagagccaaaccttcatgtttgactcttccagacggcgtatgctaggctggacaggtagccagctggacgcaaggccagaaagtgctgacgcacttcccgacctcgcttaccatcagtctaccaaacacttaaagaccttaagggcttagcgctaagcagcttaacacttagcaccgagcccttgaggggctcggcatcagccctaaggtacttatagtaactttaaaaccttaagagcttagcctttaaggatctaagttactataaaagctttcagaacttagtacttaatactttaagtaaacataaaagcttttaagtcttaaagtaaatatataaccttaagacttaaacattaacacctaagttaagtataaaaccttaaaggcttagcacgtaaggatctaaacttaacatcagtgtttaagactttaaaacttaaaataaaccataaagacttaaagacttataagctttaaacacttaaagtaactataagactttaaagaccttaagtacttaaagttaaccatcagtcttaaactttaatcttataacctataagtcttaaagcttataagttataaaagtttttagaagagtaaaggggttaacttctttacttctcttctctctttggttctttctctcttctcttcttttcttcatcaggggagaagaggaaccttttgccatcagcgctgatgggttttcgccgtgtgtctcgtgtgctcctggtcgcacgctcccgtcgcacactccccacactcttacacccgtgtccctttcaggcttagcgtgttcggctgaaggcgtacggcgtgtcacgctaacacccttaacatcaggtgagacttaaagtgtatattatatgtagaagactttaaaacctttaagggtgtacacgtttaggctgtgtccaacactgctaggcgcgaagtgctaagccttaaagcgctaacacacacccacccccatttttcttccgtgtccttttctttttgacaccgctggggggcgatgtgatctttctcacacccgtgggggtaggagagaaaaacaaacaccccaccacgatcacaaccccccaccaaacgaacaaaacagcccccagaatcgactagtagggcacaggtggggtaaacctaccccggacacattccaggctgttacagagacaacgagaagcttacaagggcttgggtgatgaggaggcgcgatggcacacaccaaccgcaccgcatcctccgcccaccgacgctggcgcgagcgactcatcacccaagcccgacaacaaggccaaaccgaatgcccactctgcggagcaaccatcacctgggacactcaccaactaccaaccagccccgaagccgaccacatcacacccgtcagccggggaggactcaacaccctcgacaacgggcaaatcatctgcagaacatgcaacagaagcaaaggcaatcgcagcgaaccaaacatcagtttccaacaacaaaccacaaaaacccttgtcacctggtgaaaaaccagccaacccccgacggggaccaccccctgcacacccgtgcaagacc

SEQ ID NO: 39 - DNA, 29512 bp, Unknown
  source: /note="Description of Unknown: Bacteriophage of P. acnes"
agtgaaatacctcccctttgttgttttatcgttttgtcgactttttgtttggtggtgatggtggtgcagcctgagcttcccgagtctcgtgagtggtgtgaggagacgcgtcgttggtggcgtgtgtggggtgaggatgcgcgtgctgggtttgtgtctgatgaggagtggctgtttctcatggatgctgcggtgattcatgatgtggtgtggcgtgagggtcgcgcggaccttgtggcttcgcttcgtgctcatgtgaaggcgtttatgggcatgttggatcggtattcggttgatgtggcgtctggtggtagtggcgggggttctgcggtggcgatgattgacaggtatcggaagcgcaagggggcctgattaggtgtctggtgtggttggttctcaggttcctcgtcatcgtgtggcggcggcgtattcggtgtctgctggtggggatgctggtgagcttggtagggcgtatgggttgtcgcctgatccgtggcagcagcaggtgttggatgattggcttgctgttgggacgaatggccgtttggcgtctggtgtgtgtggggtgtttgtgcctcggcagaatggcaagaatgctattttggagattgtggagttgtttaaggcgactattcagggtcgccggattttgcatacggctcacgagttgaagtcggctcgtaaggcgtttatgcggcttcgatcgttttttgagaatgagcggcagtttcctgacttgtatcgtatggtgaagtcgattcgtgcaacgaatggtcaggaggctattgtgttgcatcatccggattgtgccacgtttgagcgtaagtgtggctgtccgggttggggttcggttgagtttgtggctcgtagccgggggtctgctcgcgggtttaccgttgatgatttggtgtgtgatgaggctcaggagttgtcggatgagcagttggaggctttgcttcctacagtgagcgctgccccgtctggggatcctcagcagatttttttgggtaccccgccggggccattggctgatgggtctgtggtgttacgtttgcgtgggcaggcgcttggtggcggtaaacgtatcgcgtggactgagttttcgattccggacgagacggatccggaggatttgtctcggtcgtggcggaagcttgctggggatactaatcctgcgcttggtaggcgtctgaattttggtaccgtgtctgatgagcatgagtctatgtctgctgccgggtttgctcgtgagaggcttggttggtgggatcgtggccagtctgctgtgtcggtgattcctgccgataagtgggcgctatcggcggttgatgaggtgcatctttctggtgggaaagtgtttggggtttcgttttctcgttctggtaatagggttgctttggcgggtgctggcagggcggatgctggggttcatgttgaggttattgatggcttgtcggggacgattgttgatggtgtaggccaactggctgattggctggcgttgcgttggggtgacacggaaaagattatggttgccggttctggtgcggtgcttttacagaaggctttgactgatcgtggtgtgccgggtcggggcgtgattgtggccgataccggtgtttatgttgaggcgtgccaagcttttctggagggtgtgcgttcgggtgttgtttctcatccccgtgctgattctcgccgtgacatgttggagattgctgtgaggtcggcggttcagaagcgtaagggatctgcttggggctggggctcgacgtttaaagacggcagtgaggttcctttggaggctgtgtcgctggcgtatcttggtgtgaagatggcgaaggctaagcggcgtgagcgtagtggtaggaagcgggtgtctgtggtatgaacgtggacgagttggctcttattgagggcatgtacgatcgtattaagaggttgtcttcgtggcattgccgtattgagggctactatgagggttcgaatcgtgtccgtgatttgggggttgctattcctcctgagttgcagcgtgtgcagacggtggtgtcgtggcctgggatagcggtggatgctttggaggagcgtctggattggcttggctggactaatggtgacggctacggtttggatggtgtgtattctgcgaatcggcttgctacggcgtcgtgtgatgtgcatttggatgcgctgatttttggtttgtcgtttgtggctgttattccccaagaggatgggtcggtgttggttcgtccgcagtcaccaaagaattgcaccggaaagttttcggctgacgggtcgcgtcttgatgctggcctggtggtgcagcagacgtgtgatcctgaggttgttgaggcggagcttttgcttcctgatgtgattgttcaggttgagcggcgggggtctcgtgagtgggtcgaggtgggccgtataccgaatgtgttgggtgcggttcctttggtgccgattgtgaatcggcgcaggacgtctcgtattgatgggcgctccgagattacgaggtctattcgtgcttacacggatgaagcggttcgcacgctgcttgggcagtctgtgaatcgtgatttctatgcttacccgcagcgctgggttacgggtgtttctgcggacgagttttctcagcctggctgggtgttgtctatggcttctgtgtgggctgtggataaggacgatgacggtgatactccgaatgttgggtcgtttcctgttaatagtcctaccccttattctgatcagatgcggctattagcccagttgactgctggggaggctgcggtgcctgagcgctatttcgggtttatcacgtctaacccgccgtcgggtgaggcgcttgcggcggaggagtctcgactggttaagcgtgctgagcggcgtcaaacatcgtttggtcagggctggctgtcggttggttttctggctgcgaaggcgttggattctcgcgtggatgaggctgcttttttcggtgatgtgggtttgaggtggcgtgacgcgtcaaccccgactcgggcggctacggcggatgctgtgacgaagcttgtgggtgccggtattttgcctgctgattctcggacggtgttggagatgttgggtttggatgatgtgcaggttgaggctgtgatgcggcatcgcgccgaatctgcggatccgttggctgcgttggctggggctatttctcgtcaaactggcgaggtttgatggatggcttcgggtgtgatgtcgaggctggcggcgactgagtatcagcgtgaggcggtccggtttgccgggaagtatgcgggctattatgccgagcttggtcgtttgtggcattccggaaaaatgagtgacacgcagtatgtgcgtttgtgtgtcgagttggagcgtgccggccatgatggttcggcgtcgttggcggcaaggtttgtgtcggattttcgccggttgaatggtgtggatcctggtttgattgtgtatgacgagtttgatgctgctgctgcgttggcccggtcgattgcgaccacgaagattttgaagggtgatccggatagggcgaatgatactattgatgcgatggcggcgggttttgatcgggctgtgttgaatgctggccgtgacacggttgagtggtcggcgggtgcgcagggccggtcgtggcgtcgtgtcacggatggtgatccgtgtgctttttgtgcgatgcttgcaaccaggtcggattatacgactcgggagcgtgcgctaaccgtggggcatactcggcgtcataggcggggtggtaagcgtccgctgggttcgaagtatcatgatcattgtgggtgtacggtggttgaggttgttgggcgttgggagcccagttccgcggacaccgcatatcagcgggtttatgagaaggctcgtgagtgggttgatgatcatgggttgcagcagtcgcctggcaatattttgaaggctatgcgtactgttggcgatatgagatgattgatatggtttccggttgtgcgccgccggttatcggtgcacgtggttgtctcccgcacggggggcggcaagattgtgttgttttccgcaaggagtgtagggttaggctatggccgatcagaatgttgaagaacaaaacgtcgacaaagtagaagaggttcccgaaaagggtgacgttgttgacgtcgtaaaggatgatcaaagcgggcagacaggcgatcagtcgaagcatgatggtggagataagccgtctgggactgattggaaggctgaggctcgtaagtgggagtctcgtgctaaaagtaatttcgccgagttggagaagcttcgcgcctcggatggtgatgcggggtctactattgatgagcttcgccgtaagaatgaggagctcgaagaccggattaatgggtttgttcttgagggtgtgaagcgcgaggtggctgccgagtgtggcctttcggccgatgcggtagcttttctgtctggcggtgatcgcgagtcgcttgccgagtctgctaaagcccttaaggggctgattgaccatagtggtagtggtggcgcgggtgtgcgccgtcttgcggggagtgcccccgtggatgatgttaaacgacgtgagggtgtcgcgtttgtggatgctcttgtcaataattctaggagatgatttatcatggctgacgattttctttctgcagggaagcttgagcttcctggttctatgattggtgcggtgcgtgaccgtgctatcgattctggtgttttggcgaagctttcgccggagcagccgactattttcggacctgtgaagggtgccgtgttttcgggtgttcctcgcgccaagattgttggtgagggcgaggttaagccttccgctagcgttgatgtttccgcgtttactgcgcagcctatcaaggttgtgactcagcagcgtgtctcggacgagtttatgtgggctgacgccgattaccgtctgggtgtgcttcaggatctgatttcgcctgctctgggtgcttctattggtcgcgctgtggatcttattgctttccatggtgttgatccggctacaggtaagccggctgctgctgttaaggtgtcgctggataagacgtcgaagacggttgatgccacggattctgccacgaccgatctggtcaaagcggtagggctgattgcgggtgctggtttgcaggttcctaacggtgtcgccctggatccggcgttctcgtttgcgctgtctaccgaggtgtacccgaaggggtctccgcttgccggtcagccgatgtatcctgccgccggtttcgctgggcttgataattggcgtggacttaatgttggtgcttcttcgactgtttcgggtgccccggagatgtcgcctgcctcgggtgttaaggctattgttggtgatttctctcgtgttcattgggggttccagcgtaacttcccgatcgagctgatcgagtatggcgatccggatcagactgggcgtgatcttaagggccataatgaggttatggttcgtgctgaggctgtgctgtatgtggctatcgagtctctggattcgtttgctgttgtgaaggagaaggctgcaccgaagcctaatcctccggccggtaactgatttattgtagcggtgatatgtatatgtgcagggggtggtgttgatgggtatcattttgaggcctgaggatattgagcctttcgccgatattcctaaagataagcttgaggcgatgatcgctgatgtggaggctgttgctgtcagtgtcgccccctgtatcgctaaaccggacttcaaatacaaggatgctgccaaggctattctgcgtcgtgctttgttgcgctggaatgatactggcgtgtcggggcaggtgcagtacgagtctgcgggaccgtttgcccagactacacggtctaatacgcctacgaatttgttgtggccttctgagattgctgcgttgaagaagctgtgtgagggtgacggtggggctggtaaagcgttcacgatcacacccacgatccgtggcggatatgcacattctgaggtgtgttctactgtgtggggtgagggctgttcgtgcgggtcgaatattaacggctacgctggccctttgtgggagatatgatatgattaattttccttacggtgaaacggttgtgatgcttcagccgactgttcgtgtcgatgatcttggcgacagggttgaggattggggccatcctgtagaaaccgtgtaccataatgtggccatctatgcttctgtgtcacaggaggatgaggctgccggccgtgacactgattgggagcattggtcgatgctgttcaagcagcctgtcaagggtgccgattatcggtgtcgttggcgtattcggggtgttgtgtgggaggctgacgggtctcctatggtgtggcatcacccaatgtctggctgggatgctggtacgcaggttaatgtgaagcgtaaaaagggctgatggttgtggcacgtgatgtgaatgtgaagcttaacttgccgggtattcgtgaggtgttgaagtcttctggggtgcagggcatgttggctgagcgtggcgagagggtcaagcatgcggcctctgctaatgtgggtggtaatgcttttgataaggcccagtatcgtgccgggttgtcgtctgaggtgcaggttcaccgtgttgaggctgtggctaggattggcaccacctataagggtggtaagcgtattgaggcgaagcatggcacgttggctaggtcgattggggctgcgtcgtgatcgtttacggtgatcctcgtgtgtgggctaaacgtgtgctcaaggatgatggctggctgtctgatataccgtgcacgggtactgtgccggatcaatttgagggtgacctgatttggcttgcgttggatggtggcccccagttgcatgttcgtgagcgtgtttttcttcgcgtgaatgtgttttcggatattccggatcgtgctatgtcgttggcgcgtcgtgttgaggctgtgctggctgatggtgttgatggtgatccggtggtgttttgtaggcgttctactggtcctgatttgttggttgatggtgcacgttttgatgtgtattcgctgtttgagctggtgtgccgtcctgtcgaatccgagtaaacgtatttgttttctatattttgtttttgtttgattatttttgggggttgtgatggctgctacacgtaaagcgtctaatgttcgctctgctgttaccggtgacgtctatattggtgccgctcacgccggtgacactattgatggtgttgggaagattcctgacggtcttaccgctttagggtacctgtcggatgacgggtttaagattaagcctgagcgtaaaacggatgatttgaaggcttggcagaatgcggatgttgttcgcaccgtggctacagagtcgtctatcgagatttctttccagctgatcgagtccaagaaggaggttatcgaactgttttggcagtcgaaggttactgccggagtcgattcgggttcgttcgatatttctcctggtgctacgaccggtgttcatgccctgttgatggatattgttgatggcgatcaggttatccgctactatttccctgaagctgagcttgtcgatcgtgacgagatcaagggtaagaatggcgaggtgtatgggtatggtgtcacactgaaggcgtatcctgcccagattaataagaagggtgatgcggtgtctggtcgggggtggatgacggctttaaaagctgatactcctccggttcctccgaagcctccgaagcctgagccggatcctaatccgccagccgagaactgatacatatttttgagggattgttgatagatgagtgacacaggtttcacgttgaagattggtgaccgtagttgggtgttggctgatgcagaggagacggcgcaggctgttcctgcccgtgtttttcgccgtgccgctaagattgcccagtcgggggagtctgctgatttcgcccaggttgaggtgatgttttctatgttggaggctgccgccccagcggatgctgtagaagcgcttgagggcttgcctatggtgcgtgttgccgagattttccgtgagtggatggaatacaagcctgacggtaagggtgcctctttgggggaatagtttggctccacggcctgattgatgattatcgtggggccatcgaatatgattggaggacccggttcggttgctctgtttatgatgttggtggcccggtgatgtgttggggtgaggctgtccggctggctggcgtgttgtgtactgatacgtcgagccagttggcagcccatctgaatggttggcagcgcccgtttgaatggtcggagtgggcggtgttggatatgttggatcattacaggtctgctaatagtgaggggcagccggagcctgtggcgaggccgacggatgagcgtcgggctaggtttacgtcgtctcaggtggacgatattttggcgcgtgttcgtgccggtggcggggtgtctcgcgagattaatattatggggtgaatagtgtatgtctggtgagattgcttccgcctatgtgtcgttgtatacgaagatgcccggtttgaaggctgatgttggtaaacagttgtcgggtgtgatgcctgctgagggtcagcgttcgggtagtctttttgcttccggtatgaagttggctttgggtggcgcggcgatgatgggtgccatcaatgttgccaagaagggcctgaaatcgatttatgatgtgactattggtggcggtattgctagggcgatggctatcgatgaggctcaggctaaactgactggtttgggtcacacgtcttctgacacgtcttcgattatgaattcggctattgaagctgttactggtacgtcgtatgcgctgggtgatgcggcttctactgcggctgctttgtctgcttctggtgtgaagtctggcgggcagatgactgacgtgttgaagactgtcgccgatgtgtcttatatttctggcaagtcgtttcaggatacgggcgctattttcacgtcggttatggctcgcggcaagctgcagggcgatgacatgttgcagcttactatggctggtgttccggtgttgtctttgcttgcgaagcagacgggtaaaacgtcggctgaggtgtcgcagatggtgtcgaaggggcagattgattttgccacgtttgcggctgcgatgaagcttggcatgggtggtgctgctcaggcgtctggtcagacgtttgagggcgctatgaagaatgttaagggcgctttgggctatcttggtgctacggctatggccccgtttttgaatgggttgcggcagatttttgttgcgttgaatccggttatcaagtcggtcacggattctgtgaagcccctgtttgcgtcggtggatcaggggattcagcgggtgatgccgtctattttggcgtggattaatcgtatgccgggcatgattacgagaatgaatgcacagatgcgcgccaaggtggagcagttgaagggcatttttgcgagaatgcatttgcctgtccctaaggtgaatttgggtgccatgtttgctggcggcaccgcagtgtttggtattgtggctgccggtgtggggaagcttgttgcggggtttgccccgttggcggtgtcgttgaagaatttgttgccgtcgtttggtgctttgaagggtgccgctggcgggcttggcggcgtgttccgtgccctgggtggccctgtcgggattgtgatcggcttgtttgctgccatgtttgcgacgaatgtccagttccgtgcctctgtgatgcagcttgtgggtgttgtcggtcaggcgttggggcagattatggctgctgtgcagccgctgtttggtttggttgcgggtgttgtggcccagttggcgccagtgtttggccagattattggtttggtggctggtttggctgcccagctggtgcctttgattagtatgcttgtcgcccggctagttcctgtgatcacgcagattattggtgcggtgacacaggttgcggccatgctgctgccagcactgatgccggtgttgcaggctgttatggctgtgatacggcaggttgttggcgtgatcatgcagcttgtgccggttttgatgcctgtgattcaacagattttgggtgctgtgatgtctgttctgccgcctattattggtttgatacggtcgctgataccagtcatcatgtcgattatgcgtgtagtgatgcaggttgttggtgccgtgttacaggtggtggcccgtattattccggttgtggctccggttgttggggctgtgatagggtttgttgcacgtattcttggcgctattgtgtctgccgcagcccgcattattggcgctgtaacccgtgttatcggatgggttgtgagccatctggtgtctggtgtggcgcgtatgggtacggccatcctgaatggctggaatcatattagggctttcacgtctgcgtttattaacggtttcaagtcgatcatttcgggcggcgtgaatgctgttgtggggttttttgcccggcttggttcttcggtggctagccatgttcggtctgggtttaacgcggcccgtggtgctgtttcttccgcaatgaatgctatccgtagtgtggtgtcttcggtggcgtctgctgttggcgggttcttcgggtcgatggcgtctagggttcgtagtggtgctgcgaggggctttaatggggccaggagtgcggcttctagcgctatgcacgctatgggttctgcagtgtctagcggtgtgcatagtgtgttggggttttttcggaatctgcccggtaatattaggcgtgctctcggtaatatgggatccttgttggtgtcggctggccgtgacgtggtttctggtttaggtaatggtatcaagaatgctttgagtggcctgctggatacggtgcgtaacatgggttctcaggtggctaacgcggctaaatcggtgttgggtattcattccccgtctagggtgtttcgtgatcaggttggccgccaggttgttgccggtttggctgaggggatcaccgggaatgctggtttggcgttggatgcgatgtcgggtgtggctggccgtcttccggatgctgtggatgcccggtttggtgtgcgatcgtctgtgggctcgtttacaccgtatggcaggtatcagcgtgcgagcgagaagagtgttgtggtgaatgttaacggcccgacgtatggtgatcctaatgagtttgcgaagcggattgagcggcaacagcgtgacgcgttgaacgcgttggcttacgtgtgagtgggggtgttgtgcatgtttattcctaacccgtctgatcgtgccggtttgactgttacctggtctatgttgccgttgattggtaatgatccggagcgtgtgcttcatttgacggattatacgggtgcgtctcctgtcatgttgttgaatgattcgttgcgtggtttgggtgttcctgaggtggagcatttttctcaaactcatgttggggtgcacgggtctgagtggcgcgggtttaatgtgaagcctcgcgaggtgacgttgcctgttttggtttcgggtgttgacccggatcctgcgggcgggtttcgtgacggttttttgaaagcctatgacgagttgtggtctgcgtttcccccgggcgaggtgggggagttgtctgtgaagactcctgccggtgttgagcgtgtgctaaggtgtcggtttgattcggtggatgacacgtttacggttgatccggtgaatcgtggctatgcccgctatgtgcttcatttgatagcctatgacccgttttggtatggggatgagcaaaagtttcgtttcagtaacgcgaagttgcaggattggttgggtggcggccctgtaggcaaaaacgggactgcgtttccggtggtgttgacgcctggtgttggttcgggttgggataacctgtctaataagggtgatgtgcctgcgtggcctgtgattcgtgttgaggggcctttggattcgtggtctgtgcagattgatggtttgcgtgtgtcatcagactatccggttgaggagtttgattggatcacgattgatacggatcctcgcaaacagtctgcattgttgaacgggtttgaggatgtgatggatcgtttgaaggagtgggagtttgctcctatcccgccaggcggttctaagagtgtgaatattgagatggttggtttgggtgccattgttgtgtcggtgcagtacaggtttttgagggcttggtgaatagttgatggctggtcttgtcccgcagataacattgtttacgccagactatcgtcgtgtggcgcctatcaatttttttgagtcgctaaagttgtcgttgaagtggaatggtttgtcgacgctggagttggtggtgtcgggggatcattccaggcttgacgcgttgacgaagccgggtgcacgccttgttgtcgattatggtggtggccagattttttctgggcctgtgcgtaaagtgcatggtgtgggtccttggcggtcttcgagggtgactatcacgtgtgaggatgatattcggctgttgtggcgtatgttgatgtggcctgtgaattatcgtcccggtttggtgggttcggagtggcgtgccgaccgtggttatgcccactattcgggtgcggcggagtcggttgctaagcaggtgttgggggataatgcgtggcgttttccgccaggtttatttatgaccgatgatgagcgtcgtggccgctatattaaggattttcaggtgcggtttcacgtgtttgccgataaattgttgccggtgttgtcgtgggctcggatgactgtttcggtgaatcagtttgaggataaggtgaatgatcagcggggtttagtgtttgattgtgtgcccgcggtgacgcgtagccatgtgttgactgccgagtcgggttcgattgtgtcgtgggagtatgtgcgtgacgcccctaaggctacgtcggtggttgttggtggccgcggcgagggcaaggatcggctgttttgtgaggatgttgattcgatggctgagggggattggtttgatcgtgtcgaggtgtttaaggatgcccgtaacacggattctgagaaggtgtctctctttgatgaggctgagcgggtgttgttcgagttaggggccacgtcggggtttaagatcgagttggccgagtcggatgtgttgcgttttgggcccggcaagctgatgcccggggatttgatttatgtggatgtgggttctggccctattgcggagattgttcggcagattgatgtggagtgtgattcgcctggtgacggctggacgaaggtgactcctgttgcgggggattatgaggataatccgtctgccctgttggctcgccgtgtggctggtttggctgcaggtgtgcgggatttgcaaaagttttaaaagtgatgggggtttgttgtgggtattgtgtgtaaagggtttgatggtgtgttgaccgagtatgattgggctcaaatgtctggtctgatgggtaatatgccgtcggttaaggggcctgacgattttcgtgtcggcactacggttcagggtgccacggtgttgtgtgaggttttgccggggcaggcttgggctcacggggtgatgtgcacgtcgaatagtgtggagacggtgacggggcagctgcctggtcctggtgagactcgctacgattatgtggtgttgtctcgggattggcaggagaatacggccaagttggagattgttcctgggggtcgtgcggagcgtgcccgtgacgtgttgcgtgccgagcctggcgtgtttcatcagcagttgttggctactttggtggtgtcgtctaacgggttgcagcagcagttggataggcgtgccgtggcggctagggtggcgtttggggagtctgcagcctgtgatccgacacccatggagggggatcgtgtgatggttccttcgggggccgtgtgggctaatcatgctaacgagtggatgttgttgtctcccaggattgagacgggttcgaagtcgatcatgtttggcgggtctgctgtgtatgcttacacgatcccgtttgatcgccagttcagtagtccgcctgttgtggtggcgtctatggctacggcggctgggggtacgcagcagattgatgtgaaagcctacaatataactagcaaggattttggtttggcgtttatcacgaatgatgggtctaagccgaatggtgtgcccgctgttgcgaattggatagctgtgggcgtgtgaccgtgttgaggctgtggtggcggttggtgtgatgttggggggctgtggtgtcgtggtttactcctgcactggtggcctctatttgtaccgcgttggctactgttttgggttcggttcaggctgtcacatctaagtctaggaagcgtttgaggcgcctgtctgctcaggtggatgcgatggaagagtatacgtggggtgtgcggcgtgaggttcgccggtttaacgctggtcttcccgataatgtggatcctttggtgttgcctgatccgcccgggtttttgcaggatcagttggggggtgaatagatgagggagttggaggaggagaagcggcagcgccgtacttttgagaaggcttctatggtgttgttgtttctgtcgcttgtgctgttggcggtggttgctgggggtgctttgcgtttcggctctgtggtttcgcagagggattcggagcaggcgcgtgcggagtcgaatggtactgcggctaaagggttggctgcccgtgtgaagcaggtgtgcgcccagggtaggcaggagtcggtgcgtcttcaccggtctggcctgtgtgtggatgctgcccgtacggagcggagtgttcagggtgttcctggcccggctggtgagcgtggcccgcaaggccctgccggtgtggatggccgtgatggcagtaatggttcggctggtctggttggcccggttggcccgcagggttctcctggtttgaatggtgtgaaggggcctgacgggttgcccggtgctgacggcaaggatggccatggtggtgttccgggccgtgcaggtgatgacggtgtgaacggtgctgatggtcgggatggttcggccggtgaacgcggtgatgtgggcccttcaggttccgccggtccacagggtgaacggggtgagcgcggcccgcaaggccctgccggtgtcaacggatccgatggtaaagacggtaaggatgggcgtgatggccgctcggtggtgtctgtgtactgctcggagggccgcctgtttgtgaaatatagtgacggtgcgtcttctacagtgtcagggtctagggcgtgcccgggtgtggccccgtcgccgattgtgaccgtgtcatcccacaaatagtaagaggaagggtgttactagtgttgatgatgttttggggtggtgtgcggtgagatacattccagcggcacaccattcggctggttctaattctccggtgaatagggttgtgattcatgcgacgtgcccggatgtggggtttccgtccgcctcgcgtaagggtcgggcggtgtcgacggcgaactatttcgcgtccccatcgtctggtggctctgcccattatgtgtgtgatattggggagacggtgcagtgcctgtccgagtctactattgggtggcatgccccgcctaatccgcattctttgggtatagagatttgtgcggatggcggttcgcacgcctcgttccaggttccggggcacgcgtatacgcgggagcagtggctgtcgcctgaggtgtggcctgcggtggagcgggctgctgtcctgtgtaggcggttgtgtgaccggcatggtgttccgaaacggaagctgtccgtatcggatttgaaggccggcaagaggggtgtttgcgggcatgtggatgttacggatgcgtggcatcagtcggatcatgatgatccggggccgtggtttccgtgggacaggtttatggccgtagtctgcggccacgatagtggtagtgatagtggggagttaactgtggctgatgtgaaagcgctgcatgatcagattaaacaattgtctgcgcagcttactggttcggtgaacaagctgcaccacgatgttggtgtggtacaggtgcagaatggtgacttgggtaaacgtgtcgatgccctgtcgtgggtgaagaatccggtgacggggaagctgtggcgtacgaaggatgctttgtggagtgtctggtactatgtgttggagtgtcgcagccgcattagcaggcttgagtctgatatcaatagtttaaagaagtgatgtgtggtgggtaaacagttttggttgggcctgttagagcgcgccctgaaaacttttattcaaacgtttgttgctgtgcttggggtgactgcgggtgtcacctataccgcggagtcgtttcgtgggcttccgtgggagtcagctttgatcacagccacggtggctgctgtgctgtctatagcgacttcgtttggtagcccgtcgtttgtggccggtaaacccaaggttgctccggttgttgatgccggtcttgttccacccgatgataccggcctggtagaaccgcatgcggttgacgaaacggatcctggcatgatcgagccgatggatgatgataatgtggactatgtgccgaggcgtgcatccgagtctgaggttggcacggtagagccgtcagaatcataagtgaatatagtgtgtgccccagcggtgctgccacgtgtgtggtggctgctgctggggcactatttttgtgtctactgtatggctatgattcgttgttgtcgatggtggcttcgagcatctggtgcaggtgttcacactcggatatggtgtcacgggcttgatctaaaatgtctcgccggatcacgtttttgtggttgttgctgaggctgataagcgaacacatgatatcgtcggcggcggattgtagtagtttggcctggtatgcgattccggcgagccagtctatggcttccgggcttgcctgtgtgttgtctggcatgccactggtgttgctgttgtttgtggggtatcctgcactgtcgcagtcccacaggatttcgctgcactcgtctagcgtgtcttgatcgatgttgaggttgtcgaggctgacttctttgatggtgagatttacatcatctaaagagatgtggacgtggtattcgtcttgaatgtcggccacaatgttttccagctggttcatgttggtgggctgttgttggatgattcggtgtaccgctgttttgagggcagcgtgggggatattggttgtgttgttcatggttttatttcatccctgtactatcgtcgtctatgtatgatgttgtgttggcgtatttggtgagtgtgatcagtgtttggtctgcccactgtttcaccgtctgcctagtcacacccaatcgctgggctgccaccgaataggtttgatcatacccgtatacttccctgaatgcagccagccgtgccagccgtttcctctgtttggatggttcacaggtgagggtgtagtcgtcgatggctagctgtaggtcgatcatggtaacaatgttgttgccgtggtgttgtggagcggttggcgggggtggcatacctggctctactgatggtttccatggtccgccgttccagatccattgggcggcttgaatgatgtcggctgtggtgtaggtttggttcatgtgtcacccccggaacaggttgtcgaggttgtctaggttggggctggtgtttgtggtgtcgaatcgtcctacgcagtggcagtagtcgtacatgagtttaataatgtgttgatggtcaccaaggtaggtgttgccgctgatgctgtaggtggctgtgccgtctttgctgatggtgtatttggcggtgatagtttcgggtgtttcggtgttggtgatgatggcggtggtggtggtgcctactgtttggagtacggtggtttgggttccgtcgtcgagggttgtagtaaccataatgggggttctccttttagttgctggtttgattgtcggctatagtggtgatttcttgcaccggtttggggagatccaaatgctgtatggttttgttggctagccgtttggctaccctgtagcacattttggtgtagtgtttgttgtctaggttgtggtattgttctcgcaccgcaatatatagtagggagtcttggtacaggtcgtctgcgctgattgcggggtagtgttcggctattttggcgcatgcccggttgagtgtgcgtagatgatggtctgtggcccatccccacgatgctgtggtggccaggtctgcttttgttggtcgtctactcatgacactatttcatctcgctatctggtagttgtttggtgttttgttgttgatagtgtagcacacgagtccggggttgccggtggtgcctgtgcggtgccggtaccagacggattctccttccatggatgggcattgaataaaggtgcgttgtccttgctcggagatttctaggtggtgccggtgtcctgccatgaggatgtgggatgtggtgccgttgtggaattcttggcctcgccaccattcgtagtgttggttgttgcgccattggtggccgtgggcgtgaaggattttggtgcctgccacatcgacggtagtggtcatttcgtcccggctagggaagtggaagtgaaggttgggatattggttgttgagctggtaggcttctgcgatggcccggcagcagtccacgtcgaaggagtcatcgtaggtggtgacgcctttaccgaatcgtacggcttccccatggttgcctgggatggatgtgacggtgacgttggggcagtggtcgaacatgtggatgagttgcatcatggccatgcgggtgagcctgatttgttccgtcaagggtgtttgtgtgcgccaggcgttgttgcctccttgtgacacgtatccttcgatcatgtcgccgaggaaggcgatgtggacccggccgggtttgcctgcctgttgccagtagtgtttggcggctgtgagggatcgaagatagtcgtctgcgaagtgtgctgtttcaccctgagggatgcctttgccgatttggaagtcgcctgcccctaccacaaacgcacaatcactgttgttgctggtggtgtcggctggtttggggggctgccagtcggctagcttgtcgacgagttcatccacgggatacgggtctgttgcgggttggtggtcgatgattttttgtatggatcggcctgtttctccgttggggagtgtccattcggagatgcgtgtgcggcgtacggttccattggctagatcgtcgcagatggtgtctgcttcgtcattgtgctgggctagctgtgtgaggagccggtctatattgtctatcactggttttcctcctctttctgggtgttggtttgttggcggcgatagtctttgataacggtggcggagatggggtatcctgcctgggtgagctgtttcgctagccacgaggctgggatggttttgtctgcgagcacgtcggctgcttttgccccgtagcgttgaataagggtttcagttttggttgccatgatatcctatcggttgtgtggcgggctgccatcctgtgcggcagtcgccgtcgtgtcctggtttgcgtgtgcaccaggatatggttccgtctgtgtggttgagtgttttgccgcacatgacgttttgtagatgctctggcagtgcgccgtcaccctggttgctggtttgtgtgtcgaagagtgttttctggttagtgaaatgctcggatacggtcccgttgtggacgggtagtatccatgttttccattgctgctgtagcctggtgttccagtggaattgtttggccgcgttttctgcctgttttaaggttttgtagtagccaacgagtatgcgctggtgttgctggtcgggagggtttgggcctcgccagtattgtgcggccacggcgtagcggttgctggctgtgaaggtgttccagcagtattcgataatgttgttgagtgtgtcgtctgtgaagtcgtctgggttgtgttctgttgcctgggtgataatgccgcggatggcttgccggtttttggtggcgggtttgaacgagatgctcacgatagtaccggcttgtcgtcttgcatgaactggttgaaggtgttgttcccggcgtgttgggcttgtgtgatgtcctggtcggtccagtcggggtgttgctgtttcagatagtaccagtggcacgcattgtaggtttcgtcttgtagccgtgtgagatggttttcggtgatgatttgtttccacattgtccatgacacgtcgagccggttgaggatttcgagggctgggatgttgaattggttgaggaagaggatttcgtaggtgtagtagtttttctcgtattggtcccatccgcttcggtgcctgttgggctggtttttggggtaggcttcccggcatactttgtgtaaacgtttggccatgtcgtcgggtagtttaatgtcggggttggcgcggatcatggatcgcatcccatcataggtggtgccccaggtgtgcatgatgtaggtggggtcttcaccatcggcccatttttctgcacagatggcgaggcggatgcgcctcctggctgcttggctggtgttgcgccggttggtgatggggcacgtgtcgaggggatccatgatattttagtgtacctttcttggtttgggttgcttgtgtggttttattgtagcactgtgttgagggcttgtgtcaaccctgttttgccggttttcaggtaggtgtctgtgacatccccgagggtgaggggcacatgggtggcttggggaagtgctgtctggagagtttgggccatcttatctcccgcggggtcggggtcggaccagatgtaaacatggtcgtagccttcgaagaatttggtccaaaagttttgccacgaggttgcgccgggtatggcgacggcgggccatccgcattgttcgagtatcatggagtcgaattcgccttcacaaatgtgcatttctgctgccgggttggccatggcggccatgttgtagatggagcctgtatccccggccggggttaagtatttggggtggttgtgggttttgcagtcgtgttgtagtgagcagcggaaacgcatttttcttatttcggctggccgcccccaaacggggtacatgtaggggatggtgatgcactggttgtagtcttcgtggccggggatggggtcattgtcgatgtatccaaggtggtggtagcgggctgtttcttcgctgatgcctcttgccgagagaaggtcgagtatgttttcgaggtgggtttcgtagagggccgaggctttctggattcggcggcgttccgcaatgttgtatgggtgtagtgagtcgtacattcgggttttcttcttccaatcgttgttgtagcttggcgaggccgcctccaacaccgcatgtgtggcagtaccagacgcccttgtcgaggttgatgctcatggagggctggtggtcatcgtggagtgggcagaggatgtgttgctcgtttttggacgggttatagcggatgcgataggtgtcgaggaggcggcgggtgtcagaggtgtgggaggagctcgttgagggttgataccacataggcttcgctccatggcttgtttcgctgtttcatgatgactagtccgatggtggattggttttttttgttgcggtgggtttcatagttgcgtgcctcgattgtggcttctttcacgaattgggcgagatgctgctggccagccttggcttcgatcacataggttttgttgccggttttgaggatgaggtcgccttcgtcctctttgccgttgaggtggaggcgttctatatcgtagccggtgttgcgtagctggtgtaggagtctggtttcccactcggcaccggcccggcggttgcgtgactgttgtgaaaccatcatagtcctttatgttcttgtgtcatgttccatggctgtttttctaccaatggcccgaagaatgtgtattcggggtaggccctgagtctttcgtatcgggtgccgtctgggctagatttgccggtgcgctgtttcaacacagcaatgcgtgcctcggctggtatcgatagcccgttgccgttatcctcgccaccatacaatgagactccgaggatgagttgtggtttttcggagaggccgtttttgatctctcgtctggctggcgggtgttcgaggtcggtgccggttttgtcggtggcgtggtgtgtgacgatgatggtggagccagtatcccgacccaatgctgtgatccattgcatggcttcttgttgggcttggtagtcactctcgcagtcttggatgtccatcaggttgtcgatgacaataaggggtgggaaggtgttccacatttccatgtaggcttgtagttccatggtgatgtctgtccaggtgatgggtgactggaatgagaatgtgatgtgttggccgtggtggatgctgtctcgatagtattctggcccgtagtcgtcgatgttttgttgtatctgggtggtggtgtgttgggtgttgagtgagatgattcgtgtggaggcctcccagggtgtcatgtcacctgaaatatatagtgctggctggttgagcatggcggtgatgaacatggctagcccggatttttggctgccggaccgccccgcaatcatcaccaaatcccctttgtggatgtgcatgtccaggctgcggtagaggggttctagttgtggtatgcggggcagctcggctgctgtttgggaggctctctcgaaggatcgttgtagagagagcatcgggaccttatctatctatcggtggttgtgggtggtcagatggagtcgatatcgatatcagcctctgctgatgctgaagtgtcatatagctggccattatcgcgcttgtctacgtattcggcaaccttatcatagatggcgtcatcaaggggtttgagcacaaccgcgttgaacccgtttttggtgcgcacggtggcgagtttgaaggcctgctcctcgccaaggtatgcctctagatcgcggatcatggagtgtgggcggtcgttattgccgcgcgctttctcaataatagcgttggggatggtttctggggtgccgttgttgagatcgtctagggtgtggaagatggtgacgtcggcgtagatgcggtctgcgacctgtccgccgtagccttcagtgttgtgttcgacgtcgtggactttgaaggcgatggcggtggcatcctggtttttggacgggttgaagaaggtgctgctgttgttgtttcggtagttggcgagtcccataactgtatcctttactgtttgtgttgttttgttggtttgtgtcggtttttatcgggtgaggctgtttcgtttattcctgaaagcctctgacacgtccgggttgctggtgattgtctttttgtactgtttgaggaggtcggctagctgtgccttgcttgttgctttgttgattttgtcaataacgatggtgttttcttgggatgcgatgttgtctacatagtttttggctgcctggtcgtatcggtcttggagaatgatggaggcgctcgcgatcagtgttgccaaatcccagtctttagagacgtcgtcgtttttgagtcctcccagtaaatcaatgatggattgtttgatgtcttctgtggtgtctcctctgatgactgcccacggggcggcatagtctccaccgtatttgagtgtgatagtgatacgatcatccgtactgttggtgtcggtcactggttctccttatctttctcgagtggtgtgatggtggttttgatcgggtacctgtaggcgtccttgccgtctaccgcccagcaggcgtctcgtacggggcatcctttacacagggctgtgacgtgggggacgaagatgccttggcttattcctttcattgcttgactgtacatgcatgatacatgccggtaggtgttgttgtcaagatcgtacagttcggttgatgtgccctgctcgaccgattgctcgtatcccttggtggtggcgggtgtccaaaacatgcctttcgtcacctggatgccgtgttgggcgagcatgtaccggtaggtgtgcaactgcatagcatcgactgggatgcgcccggttttcaggtcgaggataaacgtttcgccggtgttggtgtcggtgaagatgcggtcgatatagccgacaatctgtgtgccgtcggcgagggtggtttcgactgggtattcgatgcctggctggccgtcaatggttgcggtgatgtattctgggtggtttcgcctccatgttttccaccggtcgacgaagatggggccatagtgtatccaccaatcatagtttttcttgttgggcccgcctgactcgcacatgtttttgcacaccctgccggagggtttaatctgggtgccctcttctttgaccagggcgatttgggtgtcgaacacattgttgaaggatgagagtttgtcgggcagtgcagggtattcgacggggttatacaggtggaggtcatgctgttcggttatgtggtgtatagcactgccggcgatggttgcataccaggtgtggtgttgggcatggtagccgtgggatagtcgccatttttcaccgcattcggcccactgtgtgagtgaactgtaggagatgtggcctggatgctggatggttttcggatattgtgctagaggcatgttagttgtttttgttccatgggttgcgggtgtcttggccggcctggtgttgctggtatgcgaggagtgtcaggcagtgccaggctgcatgggccagatgcggcagatgtgattcatagtcgaggttgtttccttgctgccaggctagtagatgtctgtagagggcgtcgatactgtgacaccaggggtatcctccggtccagttgttgtcgccgtatttggtggcgccgtatccggctacttcgccgagcgagtggagggatgcggggtcgatgagggagagcctgcatagtttcagttcttttttggcgccggtgttggggtcggtgtacatgcgggtgggctcatccatgagatgtgtgcgcctttcttgagtgggttactggttgttgtcgtgggctagggctacggcgagaatgatgatggcgagggtttcagcgatgatgatgggtgttgtgatcatttggtgtcgcggggatggtaggtgagggttgatgcgcctaggagggtggcgagggcgcaggctgcgatgattgcgcaggctgctttgtggctagtgcctgttgcgtacatccatgtgatgatgccgccttggatccatgcgaggctggtgaagaatgtttcgtaactgtgcagctcaatgttgttgttgcgtgtgttcatgcttgttcctgaatgatggtgttgatggttttgtaaatgttgtacaggtctgtttcgatggtttttagctggctgatttggtggtcgaggttgatgttcgggttgagggtgttgatgcgggatgcgatgtcggtggctgtgcgtagtgtgccgccggtgtggtgaatgatgtgtgccgtgtcggcgaggccggtggtgacggcgtagtgggagaggagaggcatgataggtgtgctttctttctggtcagcgtgaagggttgatggacatgtcctcaacctgcggcttgtcttcggtaccggacacttggcagaaaaccttcacttgtgccttggatgccccgggttgctttgcggtggcaccgtaggcgatggagaaggtgtctttgtgggcgccgatgactttgtgtaggaagaggtcgatgtcggggtttccgttccagttgacaccttgcgctgcagccatctgggtggctttctgattgcaggcgtgtgctgccgtaatcatagtgagcccggtggaggtttcttcaccgcgggcttgcgcctgccgatgagccttggcctgctcggcttgtagggagcggactgcttctgcctgcttggctgtcttctcagccttgcgctgctgtgcggttttgggggtccattcggtgttggctgtggtggcctgtggggctggctgtgatgcgagtggcgggttgtcgtcgggggctggtaggaaggaggctgcggcgatgatggcgagggtggctccggcgatggtgtagcctgttttcttgttcatgaccgtgttcccctctcgtggggtttgttcgttgctgacatgattaatcattccatgggtggcatcggctgtcaagctgcgctcatttgggttgagcgttccttgtgtggctaggtgttttatcgggcgaatagggttaacaggtggccaacattgatgcgtgtcacattccagtagagttgtgtcgcctctgcctgtgtgagtggtttccactggttgtggctgtatacggttccgtcggtggcgatgaacgtgtcggggcgcatcttgtggagttcggcttccacatgctgccggtaggcttcggcgaggccctcaaaatccatatggtcgcagtggaggttttcgaggcgtgtcaggtcgaagggtgtggggcagtcgtagctggcggggctgtagagctgggtgaagtggtcggcgatcttttgcacgattattcctttccggtgatggtgtgttggttgtttgatcgtgtggcttcggcgatgatggcgtccacgtcgattgtgtcgatgatgtagtagagttcctcggcctcgtcctcggtgagtggctgccagttgcgtggcccgtatatggcgccgtcgagggtgacggtccattgtgggcggatgagccggatggcttcttcgactttggcacggtatagacggcagatgatagacgtctgggtgttgcctatgttgtgccctgttaggtgtgcggggtggagtgggttgatttctgtcggcccgtagagggttgtgaaggatggtgtgatgagtgttccatccacggtgggtgctcctttctggattgtttgggttgttgtggtttttatggtgtgatggttgcaaccgtgagtcaaggctgcgctcattcagcttgagcgtttcatgaggggtgtggtgtatatcactgaagcctttattgctcctgtaagcgtcttaaatggtctgggggtaggattatgcaggactaaccctgctagtcgattctagggcccttctagggcgtctcaggggtatgtctgggtgatggtaggtgttgtagatcattcggacgctcgaggttgtcatacatgacgatggttggggtgttctatctgggcataggttccactccctgtagtgtgtgagatagaccacatttccctagcctagtgtccatcaccaacaccccgcagctgatctggcgtggagggtgtagcccagaaatgccgtttaaagcttctagggtacacctaggagcgccttgcagggtgggggctaggtatttatacccccagcacattctgatcgattctagacgcctataagagctcgatacgtgatcagatcaccagacgcagaccatcctcccccatcctgcttagctaagcctacactatgtggacagtgtaggatactgtaggggaagaaagacacggtacaagaaagaagggggaggatccgccttaaagtcttagcacttaaggttttagcgcttagcaccgagccccctcaagggctcggcatcagcaccaccaggctcagctcatcaggcacagcctgaaagaggtacacgccatcagggaaggcttgagagtacgaggagccctagcgacgagtactcgaaagcctgagggaacacccttagtactgatgggcctagcgtgttcggaaaagacacacgagtcaagtgtgacagtccatcaggggtgaaacccgttctggctaggggtttcagccctaaccacccttaaaggttacaagagtctaagaaaatttaagaaaactcttaggaagaaagttgtgttcatgtccacccaaaaacagccaaaatagccctcaaacccgctaatagagccaaaccttcatgtttgactcttccagacggcgtatgctaggctggacaggtagccagctggacgcaaggccagaaagtgctgacgcacttcccgacctcgcttaccatcagtctaccaaacacttaaagaccttaagggcttagcgctaagcagcttaacacttagcaccgagcccttgaggggctcggcatcagccctaaggtacttatagtaactttaaaaccttaagagcttagcctttaaggatctaagttactataaaagctttcagaacttagtacttaatactttaagtaaacataaaagcttttaagtcttaaagtaaatatataaccttaagacttaaacattaacacctaagttaagtataaaaccttaaaggcttagcacgtaaggatctaaacttaacatcagtgtttaagactttaaaacttaaaataaaccataaagacttaaagacttataagctttaaacacttaaagtaactataagactttaaagaccttaagtacttaaagttaaccatcagtcttaaactttaatcttataacctataagtcttaaagcttataagttataaaagtttttagaagagtaaaggggttaacttctttacttctcttctctctttggttctttctctcttctcttcttttcttcatcaggggagaagaggaaccttttgccatcagcgctgatgggttttcgccgtgtgtctcgtgtgctcctggtcgcacgctcccgtcgcacactccccacactcttacacccgtgtccctttcaggcttagcgtgttcggctgaaggcgtacggcgtgtcacgctaacacccttaacatcaggtgagacttaaagtgtatattatatgtagaagactttaaaacctttaagggtgtacacgtttaggctgtgtccaacactgctaggcgcgaagtgctaagccttaaagcgctaacacacacccacccccatttttcttccgtgtccttttctttttgacaccgctggggggcgatgtgatctttctcacacccgtgggggtaggagagaaaaacaaacaccccaccacgatcacaaccccccaccaaacgaacaaaacagcccccagaatcgactggtagggcacaggtggggtaaacctaccccggacacattccaggctgttacagagacaacgagaagcttacaagggctataggtgatgaggaggcgcgatggcacacaccaaccgcaccgcatcctccgcccaccgacgctggcgcgagcgactcatcacccaagcccgacaacaaggccaaaccgaatgcccactctgcggagcaaccatcacctgggacactcaccaactaccaaccagccccgaagccgaccacatcacacccgtcagccggggaggactcaacaccctcgacaacgggcaaatcatctgcagaacatgcaacagaagcaaaggcaatcgcagcgaaccaaacatcagtttccaacaacaaaccacaaaaacccttgtcacctggtgaaaaaccagccaacccccgacggggaccaccccctgcacacccgtgcaagacc

SEQ ID NO: 40 - DNA, 29503 bp, Unknown
  source: /note="Description of Unknown: Bacteriophage of P. acnes"
agtgaaatacctcccctttgttgttttatcgttttgtcgactttttgtttggtggtgatggtggtgcagcctgagcttcccgagtctcgtgagtggtgtgaggagacgcgtcgttggtggcgtgtgtggggtgaggatgcgcgtgctgggtttgtgtctgatgaggagtggctgtttctcatggatgctgcggtgattcatgatgtggtgtggcgtgagggtcgcgcggaccttgtggcttcgcttcgtgctcatgtgaaggcgtttatgggcatgttggatcggtattcggttgatgtggcgtctggtggtagtggcgggggttctgcggtggcgatgattgacaggtatcggaagcgcaagggggcctgattaggtgtctggtgtggttggttctcaggttcctcgtcatcgtgtggcggcggcgtattcggtgtctgctggtggggatgctggtgagcttggtagggcgtatgggttgtcgcctgatccgtggcagcagcaggtgttggatgattggcttgctgttgggacgaatggccgtttggcgtctggtgtgtgtggggtgtttgtgcctcggcagaatggcaagaatgctattttggagattgtggagttgtttaaggcgactattcagggtcgccggattttgcatacggctcacgagttgaagtcggctcgtaaggcgtttatgcggcttcgatcgttttttgagaatgagcggcagtttcctgacttgtatcgtatggtgaagtcgattcgtgcaacgaatggtcaggaggctattgtgttgcatcatccggattgtgccacgtttgagcgtaagtgtggctgtccgggttggggttcggttgagtttgtggctcgtagccgggggtctgctcgcgggtttaccgttgatgatttggtgtgtgatgaggctcaggagttgtcggatgagcagttggaggctttgcttcctacagtgagcgctgccccgtctggggatcctcagcagatttttttgggtaccccgccggggccattggctgatgggtctgtggtgttacgtttgcgtgggcaggcgcttggtggcggtaaacgtatcgcgtggactgagttttcgattccggacgagacggatccggaggatttgtctcggtcgtggcggaagcttgctggggatactaatcctgcgcttggtaggcgtctgaattttggtaccgtgtctgatgagcatgagtctatgtctgctgccgggtttgctcgtgagaggcttggttggtgggatcgtggccagtctgctgtgtcggtgattcctgccgataagtgggcgctatcggcggttgatgaggtgcatctttctggtgggaaagtgtttggggtttcgttttctcgttctggtaatagggttgctttggcgggtgctggcagggcggatgctggggttcatgttgaggttattgatggcttgtcggggacgattgttgatggtgtaggccaactggctgattggctggcgttgcgttggggtgacacggaaaagattatggttgccggttctggtgcggtgcttttacagaaggctttgactgatcgtggtgtgccgggtcggggcgtgattgtggccgataccggtgtttatgttgaggcgtgccaagcttttctggagggtgtgcgttcgggtgttgtttctcatccccgtgctgattctcgccgtgacatgttggagattgctgtgaggtcggcggttcagaagcgtaagggatctgcttggggctggggctcgacgtttaaagacggcagtgaggttcctttggaggctgtgtcgctggcgtatcttggtgtgaagatggcgaaggctaagcggcgtgagcgtagtggtaggaagcgggtgtctgtggtatgaacgtggacgagttggctcttattgagggcatgtacgatcgtattaagaggttgtcttcgtggcattgccgtattgagggctactatgagggttcgaatcgtgtccgtgatttgggggttgctattcctcctgagttgcagcgtgtgcagacggtggtgtcgtggcctgggatagcggtggatgctttggaggagcgtctggattggcttggctggactaatggtgacggctacggtttggatggtgtgtattctgcgaatcggcttgctacggcgtcgtgtgatgtgcatttggatgcgctgatttttggtttgtcgtttgtggctgttattccccaagaggatgggtcggtgttggttcgtccgcagtcaccaaagaattgcaccggaaagttttcggctgacgggtcgcgtcttgatgctggcctggtggtgcagcagacgtgtgatcctgaggttgttgaggcggagcttttgcttcctgatgtgattgttcaggttgagcggcgggggtctcgtgagtgggtcgaggtgggccgtataccgaatgtgttgggtgcggttcctttggtgccgattgtgaatcggcgcaggacgtctcgtattgatgggcgctccgagattacgaggtctattcgtgcttacacggatgaagcggttcgcacgctgcttgggcagtctgtgaatcgtgatttctatgcttacccgcagcgctgggttacgggtgtttctgcggacgagttttctcagcctggctgggtgttgtctatggcttctgtgtgggctgtggataaggacgatgacggtgatactccgaatgttgggtcgtttcctgttaatagtcctaccccttattctgatcagatgcggctattagcccagttgactgctggggaggctgcggtgcctgagcgctatttcgggtttatcacgtctaacccgccgtcgggtgaggcgcttgcggcggaggagtctcgactggttaagcgtgctgagcggcgtcaaacatcgtttggtcagggctggctgtcggttggttttctggctgcgaaggcgttggattctcgcgtggatgaggctgcttttttcggtgatgtgggtttgaggtggcgtgacgcgtcaaccccgactcgggcggctacggcggatgctgtgacgaagcttgtgggtgccggtattttgcctgctgattctcggacggtgttggagatgttgggtttggatgatgtgcaggttgaggctgtgatgcggcatcgcgccgaatctgcggatccgttggctgcgttggctggggctatttctcgtcaaactggcgaggtttgatggatggcttcgggtgtgatgtcgaggctggcggcgactgagtatcagcgtgaggcggtccggtttgccgggaagtatgcgggctattatgccgagcttggtcgtttgtggcattccggaaaaatgagtgacacgcagtatgtgcgtttgtgtgtcgagttggagcgtgccggccatgatggttcggcgtcgttggcggcaaggtttgtgtcggattttcgccggttgaatggtgtggatcctggtttgattgtgtatgacgagtttgatgctgctgctgcgttggcccggtcgattgcgaccacgaagattttgaagggtgatccggatagggcgaatgatactattgatgcgatggcggcgggttttgatcgggctgtgttgaatgctggccgtgacacggttgagtggtcggcgggtgcgcagggccggtcgtggcgtcgtgtcacggatggtgatccgtgtgctttttgtgcgatgcttgcaaccaggtcggattatacgactcgggagcgtgcgctaaccgtggggcatactcggcgtcataggcggggtggtaagcgtccgctgggttcgaagtatcatgatcattgtgggtgtacggtggttgaggttgttgggcgttgggagcccagttccgcggacaccgcatatcagcgggtttatgagaaggctcgtgagtgggttgatgatcatgggttgcagcagtcgcctggcaatattttgaaggctatgcgtactgttggcgatatgagatgattgatatggtttccggttgtgcgccgccggttatcggtgcacgtggttgtctcccgcacggggggcggcaagattgtgttgttttccgcaaggagtgtagggttaggctatggccgatcagaatgttgaagaacaaaacgtcgacaaagtagaagaggttcccgaaaagggtgacgttgttgacgtcgtaaaggatgatcaaagcgggcagacaggcgatcagtcgaagcatgatggtggagataagccgtctgggactgattggaaggctgaggctcgtaagtgggagtctcgtgctaaaagtaatttcgccgagttggagaagcttcgcgcctcggatggtgatgcggggtctactattgatgagcttcgccgtaagaatgaggagctcgaagaccagattaatgggtttgttcttgagggtgtgaagcgcgaggtggctgccgagtgtggcctttcggccgatgcggtagcttttctgtctggcggtgatcgcgagtcgcttgccgagtctgctaaagcccttaaggggctgattgaccatagtggtagtggtggcgcgggtgtgcgccgtcttgcggggagtgcccccgtggatgatgttaaacgacgtgagggtgtcgcgtttgtggatgctcttgtcaataattctaggagatgatttatcatggctgacgattttctttctgcagggaagcttgagcttcctggttctatgattggtgcggtgcgtgaccgtgctatcgattctggtgttttggcgaagctttcgccggagcagccgactattttcggacctgtgaagggtgccgtgttttcgggtgttcctcgcgccaagattgttggtgagggcgaggttaagccttccgctagcgttgatgtttccgcgtttactgcgcagcctatcaaggttgtgactcagcagcgtgtctcggacgagtttatgtgggctgacgccgattaccgtctgggtgtgcttcaggatctgatttcgcctgctctgggtgcttctattggtcgcgctgtggatcttattgctttccatggtgttgatccggctacaggtaagccggctgctgctgttaaggtgtcgctggataagacgtcgaagacggttgatgccacggattctgccacgaccgatctggtcaaagcggtagggctgattgcgggtgctggtttgcaggttcctaacggtgtcgccctggatccggcgttctcgtttgcgctgtctaccgaggtgtacccgaaggggtctccgcttgccggtcagccgatgtatcctgccgccggtttcgctgggcttgataattggcgtggacttaatgttggtgcttcttcgactgtttcgggtgccccggagatgtcgcctgcctcgggtgttaaggctattgttggtgatttctctcgtgttcattgggggttccagcgtaacttcccgatcgagctgatcgagtatggcgatccggatcagactgggcgtgatcttaagggccataatgaggttatggttcgtgctgaggctgtgctgtatgtggctatcgagtctctggattcgtttgctgttgtgaaggagaaggctgcaccgaagcctaatcctccggccggtaactgatttattgtagcggtgatatgtatatgtgcagggggtggtgttgatgggtatcattttgaggcctgaggatattgagcctttcgccgatattcctaaagataagcttgaggcgatgatcgctgatgtggaggctgttgctgtcagtgtcgccccctgtatcgctaaaccggacttcaaatacaaggatgctgccaaggctattctgcgtcgtgctttgttgcgctggaatgatactggcgtgtcggggcaggtgcagtacgagtctgcgggaccgtttgcccagactacacggtctaatacgcctacgaatttgttgtggccttctgagattgctgcgttgaagaagctgtgtgagggtgacggtggggctggtaaagcgttcacgatcacacccacgatccgtggcggatatgcacattctgaggtgtgttctactgtgtggggtgagggctgttcgtgcgggtcgaatattaacggctacgctggccctttgtgggagatatgatatgattaattttccttacggtgaaacggttgtgatgcttcagccgactgttcgtgtcgatgatcttggcgacagggttgaggattggggccatcctgtagaaaccgtgtaccataatgtggccatctatgcttctgtgtcacaggaggatgaggctgccggccgtgacactgattgggagcattggtcgatgctgttcaagcagcctgtcaagggtgccgattatcggtgtcgttggcgtattcggggtgttgtgtgggaggctgacgggtctcctatggtgtggcatcacccaatgtctggctgggatgctggtacgcaggttaatgtgaagcgtaaaaagggctgatggttgtggcacgtgatgtgaatgtgaagcttaacttgccgggtattcgtgaggtgttgaagtcttctggggtgcagggcatgttggctgagcgtggcgagagggtcaagcatgcggcctctgctaatgtgggtggtaatgcttttgataaggcccagtatcgtgccgggttgtcgtctgaggtgcaggttcaccgtgttgaggctgtggctaggattggcaccacctataagggtggtaagcgtattgaggcgaagcatggcacgttggctaggtcgattggggctgcgtcgtgatcgtttacggtgatcctcgtgtgtgggctaaacgtgtgctcaaggatgatggctggctgtctgatataccgtgcacgggtactgtgccggatcaatttgagggtgacctgatttggcttgcgttggatggtggcccccagttgcatgttcgtgagcgtgtttttcttcgcgtgaatgtgttttcggatattccggatcgtgctatgtcgttggcgcgtcgtgttgaggctgtgctggctgatggtgttgatggtgatccggtggtgttttgtaggcgttctactggtcctgatttgttggttgatggtgcacgttttgatgtgtattcgctgtttgagctggtgtgccgtcctgtcgaatccgagtaaacgtatttgttttctatattttgtttttgtttgattatttttgggggttgtgatggctgctacacgtaaagcgtctaatgttcgctctgctgttaccggtgacgtctatattggtgccgctcacgccggtgacactattgatggtgttgggaagattcctgacggtcttaccgctttagggtacctgtcggatgacgggtttaagattaagcctgagcgtaaaacggatgatttgaaggcttggcagaatgcggatgttgttcgcaccgtggctacagagtcgtctatcgagatttctttccagctgatcgagtccaagaaggaggttatcgaactgttttggcagtcgaaggttactgccggagtcgattcgggttcgttcgatatttctcctggtgctacgaccggtgttcatgccctgttgatggatattgttgatggcgatcaggttatccgctactatttccctgaagctgagcttgtcgatcgtgacgagatcaagggtaagaatggcgaggtgtatgggtatggtgtcacactgaaggcgtatcctgcccagattaataagaagggtgatgcggtgtctggtcgggggtggatgacggctttaaaagctgatactcctccggttcctccgaagcctccgaagcctgagccggatcctaatccgccagccgagaactgatacatatttttgagggattgttgatagatgagtgacacaggtttcacgttgaagattggtgaccgtagttgggtgttggctgatgcagaggagacggcgcaggctgttcctgcccgtgtttttcgccgtgccgctaagattgcccagtcgggggagtctgctgatttcgcccaggttgaggtgatgttttctatgttggaggctgccgccccagcggatgctgtagaagcgcttgagggcttgcctatggtgcgtgttgccgagattttccgtgagtggatggaatacaagcctgacggtaagggtgcctctttgggggaatagtttggctccacggcctgattgatgattatcgtggggccatcgaatatgattggaggacccggttcggttgctctgtttatgatgttggtggcccggtgatgtgttggggtgaggctgtccggctggctggcgtgttgtgtactgatacgtcgagccagttggcagcccatctgaatggttggcagcgcccgtttgaatggtcggagtgggcggtgttggatatgttggatcattacaggtctgctaatagtgaggggcagccggagcctgtggcgaggccgacggatgagcgtcgggctaggtttacgtcgtctcaggtggacgatattttggcgcgtgttcgtgccggtggcggggtgtctcgcgagattaatattatggggtgaatagtgtatgtctggtgagattgcttccgcctatgtgtcgttgtatacgaagatgcccggtttgaaggctgatgttggtaaacagttgtcgggtgtgatgcctgctgagggtcagcgttcgggtagtctttttgcttccggtatgaagttggctttgggtggcgcggcgatgatgggtgccatcaatgttgccaagaagggcctgaaatcgatttatgatgtgactattggtggcggtattgctagggcgatggctatcgatgaggctcaggctaaactgactggtttgggtcacacgtcttctgacacgtcttcgattatgaattcggctattgaagctgttactggtacgtcgtatgcgctgggtgatgcggcttctactgcggctgctttgtctgcttctggtgtgaagtctggcgggcagatgactgacgtgttgaagactgtcgccgatgtgtcttatatttctggcaagtcgtttcaggatacgggcgctattttcacgtcggttatggctcgcggcaagctgcagggcgatgacatgttgcagcttactatggctggtgttccggtgttgtctttgcttgcgaagcagacgggtaaaacgtcggctgaggtgtcgcagatggtgtcgaaggggcagattgattttgccacgtttgcggctgcgatgaagcttggcatgggtggtgctgctcaggcgtctggtcagacgtttgagggcgctatgaagaatgttaagggcgctttgggctatcttggtgctacggctatggccccgtttttgaatgggttgcggcagatttttgttgcgttgaatccggttatcaagtcggtcacggattctgtgaagcccctgtttgcgtcggtggatcaggggattcagcgggtgatgccgtctattttggcgtggattaatcgtatgccgggcatgattacgagaatgaatgcacagatgcgcgccaaggtggagcagttgaagggcatttttgcgagaatgcatttgcctgtccctaaggtgaatttgggtgccatgtttgctggcggcaccgcagtgtttggtattgtggctgccggtgtggggaagcttgttgcggggtttgccccgttggcggtgtcgttgaagaatttgttgccgtcgtttggtgctttgaagggtgccgctggcgggcttggcggcgtgttccgtgccctgggtggccctgtcgggattgtgatcggcttgtttgctgccatgtttgcgacgaatgtccagttccgtgcctctgtgatgcagcttgtgggtgttgtcggtcaggcgttggggcagattatggctgctgtgcagccgctgtttggtttggttgcgggtgttgtggcccagttggcgccagtgtttggccagattattggtttggtggctggtttggctgcccagctggtgcctttgattagtatgcttgtcgcccggctagttcctgtgatcacgcagattattggtgcggtgacacaggttgcggccatgctgctgccagcactgatgccggtgttgcaggctgttatggctgtgatacggcaggttgttggcgtgatcatgcagcttgtgccggttttgatgcctgtgattcaacagattttgggtgctgtgatgtctgttctgccgcctattattggtttgatacggtcgctgataccagtcatcatgtcgattatgcgtgtagtgatgcaggttgttggtgccgtgttacaggtggtggcccgtattattccggttgtggctccggttgttggggctgtgatagggtttgttgcacgtattcttggcgctattgtgtctgccgcagcccgcattattggcgctgtaacccgtgttatcggatgggttgtgagccatctggtgtctggtgtggcgcgtatgggtacggccatcctgaatggctggaatcatattagggctttcacgtctgcgtttattaacggtttcaagtcgatcatttcgggcggcgtgaatgctgttgtggggttttttgcccggcttggttcttcggtggctagccatgttcggtctgggtttaacgcggcccgtggtgctgtttcttccgcaatgaatgctatccgtagtgtggtgtcttcggtggcgtctgctgttggcgggttcttcgggtcgatggcgtctagggttcgtagtggtgctgcgaggggctttaatggggccaggagtgcggcttctagcgctatgcacgctatgggttctgcagtgtctagcggtgtgcatagtgtgttggggttttttcggaatctgcccggtaatattaggcgtgctctcggtaatatgggatccttgttggtgtcggctggccgtgacgtggtttctggtttaggtaatggtatcaagaatgctttgagtggcctgctggatacggtgcgtaacatgggttctcaggtggctaacgcggctaaatcggtgttgggtattcattccccgtctagggtgtttcgtgatcaggttggccgccaggttgttgccggtttggctgaggggatcaccgggaatgctggtttggcgttggatgcgatgtcgggtgtggctggccgtcttccggatgctgtggatgcccggtttggtgtgcgatcgtctgtgggctcgtttacaccgtatggcaggtatcagcgtgcgagcgagaagagtgttgtggtgaatgttaacggcccgacgtatggtgatcctaatgagtttgcgaagcggattgagcggcaacagcgtgacgcgttgaacgcgttggcttacgtgtgagtgggggtgttgtgcatgtttattcctaacccgtctgatcgtgccggtttgactgttacctggtctatgttgccgttgattggtaatgatccggagcgtgtgcttcatttgacggattatacgggtgcgtctcctgtcatgttgttgaatgattcgttgcgtggtttgggtgttcctgaggtggagcatttttctcaaactcatgttggggtgcacgggtctgagtggcgcgggtttaatgtgaagcctcgcgaggtgacgttgcctgttttggtttcgggtgttgacccggatcctgcgggcgggtttcgtgacggttttttgaaagcctatgacgagttgtggtctgcgtttcccccgggcgaggtgggggagttgtctgtgaagactcctgccggtgttgagcgtgtgctaaggtgtcggtttgattcggtggatgacacgtttacggttgatccggtgaatcgtggctatgcccgctatgtgcttcatttgatagcctatgacccgttttggtatggggatgagcaaaagtttcgtttcagtaacgcgaagttgcaggattggttgggtggcggccctgtaggcaaaaacgggactgcgtttccggtggtgttgacgcctggtgttggttcgggttgggataacctgtctaataagggtgatgtgcctgcgtggcctgtgattcgtgttgaggggcctttggattcgtggtctgtgcagattgatggtttgcgtgtgtcatcagactatccggttgaggagtttgattggatcacgattgatacggatcctcgcaaacagtctgcattgttgaacgggtttgaggatgtgatggatcgtttgaaggagtgggagtttgctcctatcccgccaggcggttctaagagtgtgaatattgagatggttggtttgggtgccattgttgtgtcggtgcagtacaggtttttgagggcttggtgaatagttgatggctggtcttgtcccgcagataacattgtttacgccagactatcgtcgtgtggcgcctatcaatttttttgagtcgctaaagttgtcgttgaagtggaatggtttgtcgacgctggagttggtggtgtcgggggatcattccaggcttgacgcgttgacgaagccgggtgcacgccttgttgtcgattatggtggtggccagattttttctgggcctgtgcgtaaagtgcatggtgtgggtccttggcggtcttcgagggtgactatcacgtgtgaggatgatattcggctgttgtggcgtatgttgatgtggcctgtgaattatcgtcccggtttggtgggttcggagtggcgtgccgaccgtggttatgcccactattcgggtgcggcggagtcggttgctaagcaggtgttgggggataatgcgtggcgttttccgccaggtttatttatgaccgatgatgagcgtcgtggccgctatattaaggattttcaggtgcggtttcacgtgtttgccgataaattgttgccggtgttgtcgggggctcggatgactgtttcggtgaatcagtttgaggataaggtgaatgatcagcggggtttagtgtttgattgtgtgcccgcggtgacgcgtagccatgtgttgactgccgagtcgggttcgattgtgtcgtgggagtatgtgcgtgacgcccctaaggctacgtcggtggttgttggtggccgcggcgagggcaaggatcggctgttttgtgaggatgttgattcgatggctgagggggattggtttgatcgtgtcgaggtgtttaaggatgcccgtaacacggattctgagaaggtgtctctcttcgatgaggctgagcgggtgttgttcgagttaggggccacgtcggggtttaagatcgagttggccgagtcggatgtgttgcgttttgggcccggcaagctgatgcccggggatttgatttatgtggatgtgggttctggccctattgcggagattgttcggcagattgatgtggagtgtgattcgcctggtgacggctggacgaaggtgactcctgttgcgggggattatgaggataatccgtctgccctgttggctcgccgtgtggctggtttggctgcaggtgtgcgggatttgcaaaagttttaaaagtgatgggggtttgttgtgggtattgtgtgtaaagggtttgatggtgtgttgaccgagtatgattgggctcaaatgtctggtctgatgggtaatatgccgtcggttaaggggcctgacgattttcgtgtcggcactacggttcagggtgccacggtgttgtgtgaggttttgccggggcaggcttgggctcacggggtgatgtgcacgtcgaatagtgtggagacggtgacggggcagctgcctggtcctggtgagactcgctacgattatgtggtgttgtctcgggattggcaggagaatacggccaagttggagattgttcctgggggtcgtgcggagcgtgcccgtgacgtgttgcgtgccgagcctggcgtgtttcatcagcagttgttggctactttggtggtgtcgtctaacgggttgcagcagcagttggataggcgtgccgtggcggctagggtggcgtttggggagtctgcagcctgtgatccgacacccatggagggggatcgtgtgatggttccttcgggggccgtgtgggctaatcatgctaacgagtggatgttgttgtcttccagtattgagacgggttcgaagtcgatcatgtttggcgggtctgctgtgtatgcttacacgatcccgtttgatcgccagttcagtagtccgcctgttgtggtggcgtctatggctacggcggctgggggtacgcagcagattgatgtgaaagcctacaatataactagcaagaattttggtttggcgtttatcacgaatgatgggtctaagccgaatggtgtgcccgctgttgcgaattggatagctgtgggcgtgtgaccgtgttgaggctgtggtggcggttggtgtgatgttggggggctgtggtgtcgtggtttactcctgcactggtggcctctatttgtaccgcgttggctactgttttgggttcggttcaggctgtcacatctaagtctaggaagcgtttgaggcgcctgtctgctcaggtggatgcgatggaagagtatacgtggggtgtgcggcgtgaggttcgccggtttaacgctggtcttcccgataatgtggatcctttggtgttgcctgatccgcccgggtttttgcaggatcagttggggggtgaatagatgagggagttggaggaggagaagcggcagcgccgtacttttgagaaggcttctatggtgttgttgtttctgtcgcttgtgctgttggcggtggttgctgggggtgctttgcgtttcggctctgtggtttcgcagagggattcggagcaggcgcgtgcggagtcgaatggtactgcggctaaagggttggctgcccgtgtgaagcaggtgtgcgcccagggtaggcaggagtcggtgcgtcttcaccggtctggcctgtgtgtggatgctgcccgtacggagcggagtgttcagggtgttcctggcccggctggtgagcgtggcccgcaaggccctgccggtgtggatggccgtgatggcagtaatggttcggctggtctggttggcccggttggcccgcagggttctcctggtttgaatggtgtgaaggggcctgacgggttgcccggtgctgacggcaaggatggccatggtggtgttccgggccgtgcaggtgatgacggtgtgaacggtgctgatggtcgggatggttcggccggtgaacgcggtgatgtgggcccttcaggttccgccggtccacagggtgaacggggtgagcgcggcccgcaaggccctgccggtgtcaacggatccgatggtaaagacggtaaggatgggcgtgatggccgctcggtggtgtctgtgtactgctcggagggccgcctgtttgtgaaatatagtgacggtgcgtcttctacagtgtcagggtctagggcgtgcccgggtgtggccccgtcgccgattgtgaccgtgtcatcccacaaatagtaagaggaagggtgttactagtgttgatgatgttttggggtggtgtgcggtgagatacattccagcggcacaccattcggctggttctaattctccggtgaatagggttgtgattcatgcgacgtgcccggatgtggggtttccgtccgcctcgcgtaagggtcgggcggtgtcgacggcgaactatttcgcgtccccatcgtctggtggctctgcccattatgtgtgtgatattggggagacggtgcagtgcctgtccgagtctactattgggtggcatgccccgcctaatccgcattctttgggtatagagatttgcgcggatgggggttcgcatgcctcgttccgtgtgccggggcacgcgtatacgcgggagcagtggcttgacccccgggtgtggcctgcggtggagagggctgccgtgctgtgccggcagttgtgtgacaagtatggcgttccgaagaggaagctttctgtggcagatttgaaggccggtaaacgtggcgtgtgcgggcatgtggatgttacggatgcgtggcatcagtcggatcatgacgatccggggccgtggtttccgtgggacaaatttatggccgtagtctgcggcaaagatgatggaggggagttaactgtggctgatgtgaaagccttgcatgatcagattaaacaattgtctgctcagcttactggttcggtaaacaggctgcaccacgatgttggtgtagtacaggtacagaatggtgacttgggtaaacgggtggatgccctgtcgtgggtgaagaacccggttacggggaagctgtggcgcacgaaggatgctttgtggagtgtctggtattacgtgttggagtgtcgcagccgcattagcaggcttgagtctgatatcaatagtttaaagaagtgatgtgtggtgggtaaacagttttggttgggcctgttagagcgcgccctgaaaacttttattcaaacgtttgttgctgtgcttggggtgactgcgggtgtcacctataccgcggagtcgtttcgtgggcttccgtgggaatcggcgttgatcacagccacggtggctgctgtgctgtctatagctacctcgtttggtagcccgtcgtttgtggccggtaaacccaaggttgctccgcctgttgatgctgggcttgttccacccgacgatgtgggcctggtagaaccgcatgcggtggatgtgacggatcctggcatgatcgagccgatggatgatgagaatgtgggctatgtgccgaggcgtgcatccgagtctgaggttggcacggtagagccgtcagaatcataagtgaatatagtgtgtgccccagcggtgctgccacgtgtgtggtggctgctgctggggcactatttttgtgtctactgtatggctatgattcgttgttgtcgatggtggcttcgagcatctggtgcaggtgttcacactcggatatggtgtcacgggcttgatctaaaatgtctcgccggatcacgtttttgtggttgttgctgaggctgataagcgaacacatgatatcgtcggcggcggattgtagtagtttggcctggtatgcgattccggcgagccagtctatggcttccgggcttgcctgtgtgttgtctggcatgccactggtgttgctgttgtttgtggggtatcctgcactgtcgcagtcccacaggatttcgctgcactcgtctagcgtgtcttgatcgatgttgaggttgtcgaggctgacttctttgatggtgagatttacatcatctaaagagatgtggacgtggtattcgtcttgaatgtcggccacaatgttttccagctggttcatgttggtgggctgttgttggatgattcggtgtaccgctgttttgagggcagcgtgggggatattggttgtgttgttcatggttttatttcatccctgtactatcgtcgtctatgtatgatgttgtgttggcgtatttggtgagtgtgatcagtgtttggtctgcccactgtttcaccgtctgcctagtcacacccaatcgctgggctgccaccgaataggtttgatcatacccgtatacttccctgaatgcagccagccgtgccagccgtttcctctgtttggatggttcacaggtgagggtgtagtcgtcgatggctagctgtaggtcgatcatggtaacaatgttgttgccgtggtgttgtggagcggttggcgggggtggcatacctggctctactgatggtttccatggtccgccgttccagatccattgggcggcttgaatgatgtcggctgtggtgtaggtttggttcatgtgtcacccccggaacaggttgtcgaggttgtctaggttggggctggtgtttgtggtgtcgaatcgtcctacgcagtggcagtagtcgtacatgagtttaataatgtgttgatggtcaccaaggtaggtgttgccgctgatgctgtaggtggctgtgccgtctttgctgatggtgtatttggcggtgatagtttcgggtgtttcggtgttggtgatgatggcggtggtggtggtgcctactgtttggagtacggtggtttgggttccgtcgtcgagggttgtagtaaccataatgggggttctccttttagttgctggtttgattgtcggctatagtggtgatttcttgcaccggtttggggagatccaaatgctgtatggttttgttggctagccgtttggctaccctgtagcacattttggtgtagtgtttgttgtctaggttgtggtattgttctcgcaccgcaatatatagtagggagtcttggtacaggtcgtctgcgctgattgcggggtagtgttcggctattttggcgcatgcccggttgagtgtgcgtagatgatggtctgtggcccatccccacgatgctgtggtggccaggtctgcttttgttggtcgtctactcatgacactatttcatctcgctatctggtagttgtttggtgttttgttgttgatagtgtagcacacgagtccggggttgccggtggtgcctgtgcggtgccggtaccagacggattctccttccatggatgggcattgaataaaggtgcgttgtccttgctcggagatttctaggtggtgccggtgtcctgccatgaggatgtgggatgtggtgccgttgtggaattcttggcctcgccaccattcgtagtgttggttgttgcgccattggtggccgtgggcgtgaaggattttggtgcctgccacatcgacggtagtggtcatttcgtcccggctagggaagtggaagtgaaggttgggatattggttgttgagctggtaggcttctgcgatggcccggcagcagtccacgtcgaaggagtcatcgtaggtggtgacgcctttaccgaatcgtacggcttccccatggttgcctgggatggatgtgacggtgacgttggggcagtggtcgaacatgtggatgagttgcatcatggccatgcgggtgagcctgatttgttccgtcaagggtgtttgtgtgcgccaggcgttgttgcctccttgtgacacgtatccttcgatcatgtcgccgaggaaggcgatgtggacccggccgggtttgcctgcctgttgccagtagtgtttggcggctgtgagggatcgaagatagtcgtctgcgaagtgtgctgtttcaccctgagggatgcctttgccgatttggaagtcgcctgcccctaccacaaacgcacaatcactgttgttgctggtggtgtcggctggtttggggggctgccagtcggctagcttgtcgacgagttcatccacgggatacgggtctgttgcgggttggtggtcgatgattttttgtatggatcggcctgtttctccgttggggagtgtccattcggagatgcgtgtgcggcgtacggttccattggctagatcgtcgcagatggtgtctgcttcgtcattgtgctgggctagctgtgtgaggagccggtctatattgtctatcactggttttcctcctctttctgggtgttggtttgttggcggcgatagtctttgataacggtggcggagatggggtatcctgcctgggtgagctgtttcgctagccacgaggctgggatggttttgtctgcgagcacgtcggctgcttttgccccgtagcgttgaataagggtttcagttttggttgccatgatatcctatcggttgtgtggcgggctgccatcctgtgcggcagtcgccgtcgtgtcctggtttgcgtgtgcaccaggatatggttccgtctgtgtggttgagtgttttgccgcacatgacgttttgtagatgctctggcagtgcgccgtcaccctggttgctggtttgtgtgtcgaagagtgttttctggttagtgaaatgctcggatacggtcccgttgtggacgggtagtatccatgttttccattgctgctgtagcctggtgttccagtggaattgtttggccgcgttttctgcctgttttaaggttttgtagtagccaacgagtatgcgctggtgttgctggtcgggagggtttgggcctcgccagtattgtgcggccacggcgtagcggttgctggctgtgaaggtgttccagcagtattcgataatgttgttgagtgtgtcgtctgtgaagtcgtctgggttgtgttctgttgcctgggtgataatgccgcggatggcttgccggtttttggtggcgggtttgaacgagatgctcacgatagtaccggcttgtcgtcttgcatgaactggttgaaggtgttgttcccggcgtgttgggcttgtgtgatgtcctggtcggtccagtcggggtgttgctgtttcagatagtaccagtggcacgcattgtaggtttcgtcttgtagccgtgtgagatggttttcggtgatgatttgtttccacattgtccatgacacgtcgagccggttgaggatttcgagggctgggatgttgaattggttgaggaagaggatttcgtaggtgtagtagtttttctcgtattggtcccatccgcttcggtgcctgttgggctggtttttggggtaggcttcccggcatactttgtgtaaacgtttggccatgtcgtcgggtagtttaatgtcggggttggcgcggatcatggatcgcatcccatcataggtggtgccccaggtgtgcatgatgtaggtggggtcttcaccatcggcccatttttctgcacagatggcgaggcggatgcgcctcctggctgcttggctggtgttgcgccggttggtgatggggcacgtgtcgaggggatccatgatattttagtgtacctttcttggtttgggttgcttgtgtggttttattgtagcactgtgttgagggcttgtgtcaaccctgttttgccggttttcaggtaggtgtctgtgacatccccgagggtgaggggcacatgggtggcttggggaagtgctgtctggagagtttgggccatcttatctcccgcggggtcggggtcggaccagatgtaaacatggtcgtagccttcgaagaatttggtccaaaagttttgccacgaggttgcgccgggtatggcgacggcgggccatccgcattgttcgagtatcatggagtcgaattcgccttcacaaatgtgcatttctgctgccgggttggccatggcggccatgttgtagatggagcctgtatccccggccggggttaagtatttggggtggttgtgggttttgcagtcgtgttgtagtgagcagcggaaacgcatttttcttatttcggctggccgcccccaaacggggtacatgtaggggatggtgatgcactggttgtagtcttcgtggccggggatggggtcattgtcgatgtatccaaggtggtggtagcgggctgtttcttcgctgatgcctcttgccgagagaaggtcgagtatgttttcgaggtgggtttcgtagagggccgaggctttctggattcggcggcgttccgcaatgttgtatgggtgtagtgagtcgtacattcgggttttcttcttccaatcgttgttgtagcttggcgaggccgcctccaacaccgcatgtgtggcagtaccagacgcccttgtcgaggttgatgctcatggagggctggtggtcatcgtggagtgggcagaggatgtgttgctcgtttttggacgggttatagcggatgcgataggtgtcgaggaggcggcgggtgtcagaggtgtgggaggagctcgttgagggttgataccacataggcttcgctccatggcttgtttcgctgtttcatgatgactagtccgatggtggattggttttttttgttgcggtgggtttcatagttgcgtgcctcgattgtggcttctttcacgaattgggcgagatgctgctggccagccttggcttcgatcacataggttttgttgccggttttgaggatgaggtcgccttcgtcctctttgccgttgaggtggaggcgttctatatcgtagccggtgttgcgtagctggtgtaggagtctggtttcccactcggcaccggcccggcggttgcgtgactgttgtgaaaccatcatagtcctttatgttcttgtgtcatgttccatggctgtttttctaccaatggcccgaagaatgtgtattcggggtaggccctgagtctttcgtatcgggtgccgtctgggctagatttgccggtgcgctgtttcaacacagcaatgcgtgcctcggctggtatcgatagcccgttgccgttatcctcgccaccatacaatgagactccgaggatgagttgtggtttttcggagaggccgtttttgatctctcgtctggctggcgggtgttcgaggtcggtgccggttttgtcggtggcgtggtgtgtgacgatgatggtggagccagtatcccgacccaatgctgtgatccattgcatggcttcttgttgggcttggtagtcactctcgcagtcttggatgtccatcaggttgtcgatgacaataaggggtgggaaggtgttccacatttccatgtaggcttgtagttccatggtgatgtctgtccaggtgatgggtgactggaatgagaatgtgatgtgttggccgtggtggatgctgtctcgatagtattctggcccgtagtcgtcgatgttttgttgtatctgggtggtggtgtgttgggtgttgagtgagatgattcgtgtggaggcctcccagggtgtcatgtcacctgaaatatatagtgctggctggttgagcatggcggtgatgaacatggctagcccggatttttggctgccggaccgccccgcaatcatcaccaaatcccctttgtggatgtgcatgtccaggctgcggtagaggggttctagttgtggtatgcggggcagctcggctgctgtttgggaggctctctcgaaggatcgttgtagagagagcatcgggaccttatctatctatcggtggttgtgggtggtcagatggagtcgatatcgatatcagcctctgctgatgctgaagtgtcatctagctggccattatcgcgcttgtctacgtattcggcaaccttatcatagatggcgtcatcaaggggtttgagcacaaccgcgttgaacccgtttttggtgcgcacggtggcgagtttgaaggcctgctcctcgccaaggtatgcctctagatcgcggatcatggagtgtgggcggtcgttattgccgcgcgctttctcaataatagcgttggggatggtttctggggtgccgttgttgagatcgtctagggtgtggaagatggtgacgtcggcgtagatgcggtctgcgacctgtccgccgtagccttcagtgttgtgttcgacgtcgtggactttgaaggcgatggcggtggcatcctggtttttggacgggttgaagaaggtgctgctgttgttgtttcggtagttggcgagtcccataactgtatcctttactgtttgtgttgttttgttggtttgtgtcggtttttatcgggtgaggctgtttcgtttattcctgaaagcctctgacacgtccgggttgctggtgattgtctttttgtactgtttgaggaggtcggctagctgtgccttgcttgttgctttgttgattttgtcaataacgatggtgttttcttgggatgcgatgttgtctacatagtttttggctgcctggtcgtatcggtcttggagaatgatggaggcgctcgcgatcagtgttgccaaatcccagtctttagagacgtcgtcgtttttgagtcctcccagtaaatcaatgatggattgtttgatgtcttctgtggtgtctcctctgatgactgcccacggggcggcatagtctccaccgtatttgagtgtgatagtgatacgatcatccgtactgttggtgtcggtcactggttctccttatctttctcgagtggtgtgatggtggttttgatcgggtacctgtaggcgtccttgccgtctaccgcccagcaggcgtctcgtacggggcatcctttacacagggctgtgacgtgggggacgaagatgccttggcttattcctttcattgcttgactgtacatgcatgatacatgccggtaggtgttgttgtcaagatcgtacagttcggttgatgtgccctgctcgaccgattgctcgtatcccttggtggtggcgggtgtccaaaacatgcctttcgtcacctggatgccgtgttgggcgagcatgtaccggtaggtgtgcaactgcatagcatcgactgggatgcgcccggttttcaggtcgaggataaacgtttcgccggtgttggtgtcggtgaagatgcggtcgatatagccgacaatctgtgtgccgtcggcgagggtggtttcgactgggtattcgatgcctggctggccgtcaatggttgcggtgatgtattctgggtggtttcgcctccatgttttccaccggtcgacgaagatggggccatagtgtatccaccaatcatagtttttcttgttgggcccgcctgactcgcacatgtttttgcacaccctgccggagggtttaatctgggtgccctcttctttgaccagggcgatttgggtgtcgaacacattgttgaaggatgagagtttgtcgggcagtgcagggtattcgacggggttatacaggtggaggtcatgctgttcggttatgtggtgtatagcactgccggcgatggttgcataccaggtgtggtgttgggcatggtagccgtgggatagtcgccatttttcaccgcattcggcccactgtgtgagtgaactgtaggagatgtggcctggatgctggatggttttcggatattgtgctagaggcatgttagttgtttttgttccatgggttgcgggtgtcttggccggcctggtgttgctggtatgcgaggagtgtcaggcagtgccaggctgcatgggccagatgcggcagatgtgattcatagtcgaggttgtttccttgctgccaggctagtagatgtctgtagagggcgtcgatactgtgacaccaggggtatcctccggtccagttgttgtcgccgtatttggtggcgccgtatccggctacttcgccgagcgagtggagggatgcggggtcgatgagggagagcctgcatagtttcagttcttttttggcgccggtgttggggtcggtgtacatgcgggtgggctcatccatgagatgtgtgcgcctttcttgagtgggttactggttgttgtcgtgggctagggctacggcgagaatgatgatggcgagggtttcagcgatgatgatgggtgttgtgatcatttggtgtcgcggggatggtaggtgagggttgatgcgcctaggagggtggcgagggcgcaggctgcgatgattgcgagggctgctttgtggctagtgcctgttgcgtacatccatgtgatgatgccgccttggatccatgcgaggctggtgaagaatgtttcgtaactgtgcagctcaatgttgttgttgcgtgtgttcatgcttgttcctgaatgatggtgttgatggttttgtaaatgttgtacaggtctgtttcgatggtttttagctggctgatttggtggtcgaggttgatgttcgggttgagggtgttgatgcgggatgcgatgtcggtggctgtgcgtagtgtgccgccggtgtggtgaatgatgtgtgccgtgtcggcgaggccggtggtgacggcgtagtgggagaggagaggcatgataggtgtgctttctttctggtcagcgtgaagggttgatggacatgtcctcaacctgcggcttgtcttcggtaccggacacttggcagaaaaccttcacttgtgccttggatgccccgggttgctttgcggtggcaccgtaggcgatggagaaggtgtctttgtgggcgccgatgactttgtgtaggaagaggtcgatgtcggggtttccgttccagttgacaccttgcgctgcagccatctgggtggctttctgattgcaggcgtgtgctgccgtaatcatagtgagcccggtggaggtttcttcaccgcgggcttgcgcctgccgatgagccttggcctgctcggcttgtagggagcggactgcttctgcctgcttggctgtcttctcagccttgcgctgctgtgcggttttgggggtccattcggtgttggctgtggtggcctgtggggctggctgtgatgcgagtggcgggttgtcgtcgggggctggtaggaaggaggctgcggcgatgatggcgagggtggctccggcgatggtgtagcctgttttcttgttcatgaccgtgttcccctctcgtggggtttgttcgttgctgacatgattaatcattccatgggtggcatcggctgtcaagctgcgctcatttgggttgagcgttccttgtgtggctaggtgttttatcgggcgaatagggttaacaggtggccaacattgatgcgtgtcacattccagtagagttgtgtcgcctctgcctgtgtgagtggtttccactggttgtggctgtatacggttccgtcggtggcgatgaacgtgtcggggcgcatcttgtggagttcggcttccacatgctgccggtaggcttcggcgaggccctcaaaatccatatggtcgcagtggaggttttcgaggcgtgtcaggtcgaagggtgtggggcagtcgtagctggcggggctgtagagctgggtgaagtggtcggcgatcttttgcacgattattcctttccggtgatggtgtgttggttgtttgatcgtgtggcttcggcgatgatggcgtccacgtcgattgtgtcgatgatgtagtagagttcctcggcctcgtcctcggtgagtggctgccagttgcgtggcccgtatatggcgccgtcgagggtgacggtccattgtgggcggatgagccggatggcttcttcgactttggcacggtatagacggcagatgatagacgtctgggtgttgcctatgttgtgccctgttaggtgtgcggggtggagtgggttgatttctgtcggcccgtagagggttgtgaaggatggtgtgatgagtgttccatccacggtgggtgctcctttctggattgtttgggttgttgtggtttttatggtgtgatggttgcaaccgtgagtcaaggctgcgctcattcagcttgagcgtttcatgaggggtgtggtgtatatcactgaagcctttattgctcctgtaagcgtcttaaatggtctgggggtaggattatgcaggactaaccctgctagtcgattctagggcccttctagggcgtctcaggggtatgtctgggtgatggtaggtgttgtagatcattcggacgctcgaggttgtcatacatgacgatggttggggtgttctatctgggcataggttccactccctgtagtgtgtgagatagaccacatttccctagcctagtgtccatcaccaacaccccgcagctgatctggcgtggagggtgtagcccagaaatgccgtttaaagcttctagggtacacctaggagcgccttgcagggtgggggctaggtatttatacccccagcacattctgatcgattctagacgcctataagagctcgatacgtgatcagatcaccagacgcagaccatcctcccccatcctgcttagctaagcctacactatgtggacagtgtaggatactgtaggggaagaaagacacggtacaagaaagaagggggaggatccgccttaaagtcttagcacttaaggttttagcgcttagcaccgagccccctcaagggctcggcatcagcaccaccaggctcagctcatcaggcacagcctgaaagaggtacacgccatcagggaaggcttgagagtacgaggagccctagcgacgagtactcgaaagcctgagggaacacccttagtactgatgggcctagcgtgttcggaaaagacacacgagtcaagtgtgacagtccatcaggggtgaaacccgttctggctaggggtttcagccctaaccacccttaaaggttacaagagtctaagaaaatttaagaaaactcttaggaagaaagttgtgttcatgtccacccaaaaacagccaaaatagccctcaaacccgctaatagagccaaaccttcatgtttgactcttccagacggcgtatgctaggctggacaggtagccagctggacgcaaggccagaaagtgctgacgcacttcccgacctcgcttaccatcagtctaccaaacacttaaagaccttaagggcttagcgctaagcagcttaacacttagcaccgagcccttgaggggctcggcatcagccctaaggtacttatagtaactttaaaaccttaagagcttagcctttaaggatctaagttactataaaagctttcagaacttagtacttaatactttaagtaaacataaaagcttttaagtcttaaagtaaatatataaccttaagacttaaacattaacacctaagttaagtataaaaccttaaaggcttagcacgtaaggatctaaacttaacatcagtgtttaagactttaaaacttaaaataaaccataaagacttaaagacttataagctttaaacacttaaagtaactataagactttaaagaccttaagtacttaaagttaaccatcagtcttaaactttaatcttataacctataagtcttaaagcttataagttataaaagtttttagaagagtaaaggggttaacttctttacttctcttctctctttggttctttctctcttctcttcttttcttcatcaggggagaagaggaaccttttgccatcagcgctgatgggttttcgccgtgtgtctcgtgtgctcctggtcgcacgctcccgtcgcacactccccacactcttacacccgtgtccctttcaggcttagcgtgttcggctgaaggcgtacggcgtgtcacgctaacacccttaacatcaggtgagacttaaagtgtatattatatgtagaagactttaaaacctttaagggtgtacacgtttaggctgtgtccaacactgctaggcgcgaagtgctaagccttaaagcgctaacacacacccacccccatttttcttccgtgtccttttctttttgacaccgctggggggcgatgtgatctttctcacacccgtgggggtaggagagaaaaacaaacaccccaccacgatcacaaccccccaccaaacgaacaaaacagcccccagaatcgactagtagggcacaggtggggtaaacctaccccggacacattccaggctgttacagagacaacgagaagcttacaagggctataggtgatgaggaggcgcgatggcacacaccaaccgcaccgcatcctccgcccaccgacgctggcgcgagcgactcatcacccaagcccgacaacaaggccaaaccgaatgcccactctgcggagcaaccatcacctgggacactcaccaactaccaaccagccccgaagccgaccacatcacacccgtcagccggggaggactcaacaccctcgacaacgggcaaatcatctgcagaacatgcaacagaagcaaaggcaatcgcagcgaaccaaacatcagtttccaacaacaaaccacaaaaacccttgtcacctggtgaaaaaccagccaacccccgacggggaccaccccctgcacacccgtgcaagacc

SEQ ID NO: 41 - DNA, 29467 bp, Unknown
  source: /note="Description of Unknown: Bacteriophage of P. acnes"
agtgaaatacctcccctttgttgttttatcgttttgtcgactttttgtgttggtggtgagtgtggtgcagcctgagcttcctgatagtcgcgattggtgtgatgagactaggcgttggtgggatgtgtggggtgaggatcctcgtgcgcaatatgtgagcgatgaggagtggctgtttttgttggatgctgcggtgattcatgatgtggtgtggcgtgagggtcgtgctgatttggtggcttctttgcgtgctcatgtgaaggcgtttatggccatgttggatcggcattcggttgatgtggcgtctggtggccgtggtggcggttctgcggtggcgatgattgaccggtataggaagcgtaaaggggcctaatgtcgagcgttgttggttctcaggtgcctcgtcaccgggttgctgcggcgtattcggtgtctgctggcggtgatgctggggagttgggtcgtgcgtatgggttgacgcctgatccgtggcagcagcaggtgttggatgattggctggctgtcggtagtaatggcaggcttgcttcgggtgtgtgtggggtgtttgtgcctcgccagaatggcaagaatgcgatccttgaggttgtggagttgtttaaggcgactattcagggtcgccgtattttgcatacggctcacgagttgaagtcggctcgtaaggcgtttatgcggttgaggtcgttttttgagaatgagcggcagtttcctgacttgtatcgtatggtgaagtcgattcgggcgacgaatggtcaggaggctattgtttttcatcatccggattgtgccacgtttgagcgtaagtgtggttgtccgggttggggttcggtggagtttgtggcccgcagtcggggttctgctcgcgggtttacggttgatgatttggtgtgtgatgaggctcaggagttgtcggatgagcagttggaggctttgcttcctacggtgagcgctgccccgtctggtgatcctcaacagattttccttggtaccccgcctgggccgttggcggacggtagtgtggtgttgcgtcttcgtgggcaggctttgtcgggtggtaagaggtttgcgtggacggagttttcgattcctgacgagtctgatccggatgatgtgtcgcggcagtggcggaagcttgctggtgacactaatcctgcgctgggtaggcgtctgaattttgggacagtctcggatgagcatgagtcgatgtctgctgccgggtttgctcgggagcggcttggctggtgggatcgtggccagtctgctgcgtctgtgattccggcggataagtgggcacaatctgcggtggatgaggcggctctggttggtgggaaagtgtttggtgtctcgttttctcgttctggggatcgggttgctttggcgggtgccggccggactgatgctggggttcatgttgaggttattgatgggctgtcggggacgattgttgatggtgtgggccggttggctgactggttggcggttcgttggggtgatactgacaggatcatggttgccgggtctggtgcggtgttgttgcagaaggcgttgacggatcgtggtgttccgggccgtggcgtggtggttgccgatactggtgtgtatgtggaggcttgtcaggcgtttcttgagggtgttcgttcgggtgttgtgtctcatcctcgtgctgattctcgccgtgacatgttggatattgctgtgaggtcggctgtgcagaaacgtaaggggtctgcgtggggttggggttcctcgtttaaggatggttctgaggttcctttggaggctgtgtcgttggcgtttttgggggctaaacgtgttcgtcgtggccgtcgggagcgtagtggtaggaagcgggtgtctgtggtatgaactcggatgagttggctctgattgagggcatgtacgatggtatccaaaggttgtcttcgtggcattgtcgcattgagggctactatgagggctctaatcgggtgcgtgatttgggggtggctattccgccggagttgcagcgtgtgcaaacggtggtgtcgtggcctgggattgcggtggatgctttggaggagcgtctggattggcttggctggactaatggtgacggctacggcctggatggtgtgtatgctgcgaatcggcttgctacggcttcgtgtgatgtgcatttggatgcactaatttttgggttgtcgtttgtggctgttatcccccagggggatgggtcggtgttggttcgtccgcagtcaccaaagaattgcacaggccggttttctgccgatgggtctcgtttggatgctggccttgtggtgcagcagacgtgtgatcctgaggttgttgaggcggagttgttgctgcctgatgtgattgttcaggtggagcggcggggctcgcgtgaatgggttgagacgggccgtatcgtgaatagtcttggtgcggttccgttggtgcctattgtgaatcgtcgccgtacttctaggattgatggccgttcggagattacgaggtctattagggcttacacggatgaggctgtgcgcacactgttggggcagtctgtgaatcgtgatttttatgcgtatcctcagcgttgggtgactggcgtgagcgcggatgagttttcgcagcctggctgggtcctgtcgatggcttctgtgtgggctgtggataaggatgatgatggtgacactccgaatgtggggtcgtttcctgtcaatagtcctacaccgtattcggatcagatgagactgttggcgcagttgactgcgggtgaggcggctgttccggaacgctatttcgggtttatcacgtctaacccacctagtggggaggctttggctgccgaggaatctcggcttgtgaagcgtgctgaacgcaggcagacgtcgtttggtcagggctggctgtcggttggtttcctggctgccaaggcgttggattctcgtgttgatgaggccgcgttttttggtgatgttggtttgcgttggcgtgatgcttcgacgcctacccgggcggctacggctgatgctgtgacgaagcttgttggtgccggtattttgcctgctgattctcgtacggtgttggagatgttggggcttgatgatgtgcaggttgaggctgtgatgcgtcatcgtgctgagtcgtctgacccgttggcggcactggctggggctatatcgcgtcaaactaacgaggtatgataggcgatggcttcgggtgctatgtcgaggtttgctgcgactgagtatcagcgtgaggcggtcaggtttgctgggaagtatgcgggctattatgccgagttgggtcgtttgtggcattccgggaagatgacagatgcgcagtatgttcgtttgtgtgtggagttggagcgtgccggccatgatggttcggtatcgttggctgccaggtttgtgtcggattttcgccggttgaatggtgtggatcctggtttgattgtgtatgacgagtttgatgctgcggcggctttggctaggtcgttttcgactatgaagattcttgagagtgacccggatagggcgaatgatacgattgatgcgatggctgcgggttttgatcgggctgttatgaatgctggccgtgacacggttgagtggtcggcgggtgcgcagggtaggtcgtggcgtcgggttactgatggtgatccgtgtgctttttgtgccatgttggctacgaggtcggattatacgactaaggagcgggcgcttactactggtcatacgcggcgtcataagcgtggtggtaagcgtccgtttggttcgaagtatcatgatcattgtggttgtacggtggttgaggttgttggcccttgggagccaaatagggctgatgccgagtatcagaggacgtatgagaaggcccgtgagtgggttgatgatcatgggttgcagcagtcgcctggtaatattttgaaggctatgcgtactgttggtggcatgagataatttgatgtggtttccggttgtgcgccgccggttattggtgcacagggttgtctcccgcacgggggtcaacaatgttgtgttgttttccgcaaggagtgtagggttaggctatggccgatcagagtgttgaggaacagaatgttgacaatgatgttgtggagtccggaaaggataacggcattgttgatacagtaaaagacgatggcgggcaggaggtagccgacaatcagttgaagaatgaaggcgagggtaaatcgccggggactgattggaaggcggaggcccgtaagtgggagtctcgtgctaaaagtaatttcgccgagttggagaagcttcgtacatcgagtgacgattctggatctactattgatgagcttcgccgcaagaatgaggaactcgaagacaggatcaacgggtttgttcttgagggtatgaagcgcgaggtggcttcagagtatggtttgtccagtgatgcgatcgctttcttgtcgggtggcgataaggagtcgcttgccgagtctgcgaaagctttgaagggtttgatcgaccatagtagtggtggcgcgggtgtgcgccgtcttgcggggagtgcccccgttgatgatgttaaacgacgtgagggtgtcgcgtttgtggatgctcttgtcaataattctaggagatgatttctgatggctgacgattttctttctgcagggaagcttgagcttcctggttctatgattggtgcggttcgtgaccgtgctatcgattctggtgttttggcgaagctttcgccggagcagccgactattttcggcccggtgaagggtgccgtgtttagtggtgttcctcgcgctaagattgttggtgagggcgaggttaagccttccgcgtctgctgatgtttcggcgtttactgcgcagcctatcaaggttgtgactcagcagcgtgtctcggacgagtttatgtgggctgatgctgattaccgtctgggtgttttgcaggatctgatttcgcctgctcttggtgcttcgattggtcgcgctgttgatcttattgctttccatggtattgatccggctacgggtaagcctgctgcggctgtcaagtcttcgctggataatacgaagcatattgttgatgccacggattctgctacgaccgatctggtcaaggctgtcggccttatcgctggggccggtttgcaggttcctaacggtgttgctttggatccggcgttctcgtttgctttgtctactgaggtgtatccgaaggggtctccgcttgctggtcagccgatgtatcctgccgccggttttgccggtttggataattggcgcggtctgaatgttggttcttcttcgactgtttcgggtgccccggagatgtcgcctgcttctggtgtgaaggctattgttggtgatttctctcgtgttcattggggtttccagcgtaacttcccgatcgagcttatcgagtatggtgacccggatcagactgggcgtgatctgaagggccataatgaggttatggttcgtgccgaggctgtgctgtatgtggctatcgagtcgcttgattcgtttgctgttgtgaaggagaaggctgccccgaagcctaatcctccggccgagaactgattcatttgttgcggtgatatgtatatgtgcagggggtggtgttgatgggtatcattttgaagcctgaggatattgagcctttcgccgatattcctagagagaagcttgaggcgatgattgccgatgtggaggctgtggctgtcagtgtcgccccctgtatcgctaaaccggatttcaaatacaaggatgccgctaaggctattctgcgtagggctttgttgcgctggaatgataccggggtttctgggcaggtgcagtatgagtctgcgggtcctttcgctcagactacacggtctagtactcccacgaatttgttgtggccttctgagattgccgcgttgaagaagttgtgtgggggtgatggtggggctggtaaagcgttcactattacaccgaccatgaggagtagtgtgaatcattctgaggtgtgttccacggtgtggggtgagggttgctcgtgcgggtcgaatattaacggctacgctggccctttgtgggagatatgatatgaccagttttccttatggtgaaacggttgtgatgcttcaaccgactgttcgtgtcgatgatcttggtgacaaggtggaagactggtctaagcctgtcgagactgggttccataacgtggccatctatgcttccgtttcgcaggaggatgaggccgcggggcgtgactctgactatgagcattggtcgatgcttttcaagcagcctgttgtgggcgctgattatcgttgcaggtggcgtatccggggtgttgtgtgggaggctgacgggtctcctatggtgtggcatcatccgatgtccggctgggatgcgggcacgcagatcaatgtgaagcgtaagaagggctgatgggtagtggctcaggatgtgaatgtgaagctgaacttgccgggtattcgtgaggtgttgaagtcttctggggtgcaggctatgttggctgagcgtggcgagcgtgtcaagcgtgcagcctcggcgaatgtgggcggtaacgctttcgataaggcccaataccgtaatggtttgtcgtcagaggtgcaggttcaccgtgttgaggctgtcgctcgtataggcaccacatataagggtgggaagcgtattgaggcgaagcatggcacgctggctcgttcgattggggctgcgtcgtgatcgtttacggtgatccgcgtgtgtgggctaaacgcgtgctcaaggatgatggctggctgtctgatataccatgcaccgggacagtgccggatagttttgagggtgaccttatttggttggctcttgatggtggtccgcagttgcatgtgcgtgagcgtgtttttttgcggatgaacgtgttttctgatacgccggatcgtgctatgtcgctagccaggcgggtggaggctgtgctggctgatggtgtggacggtgaccctgtggtgtactgtaaacggtctactggccctgatttactggttgatggtgcacgttttgatgtgtattcgctgttcgagctgatatgcaggcctgcggagtctaaataagcttattgtttttgttttaatgtaattgtttgatatttaatgggggttgtgatggctgcaacacgtaaagcgtctaatgttcgttcagcggttactggcgacgtttatattggtgacgcgcacgcgggtgatactattaagggtgtggaggcggttccttccgggcttacagctttagggtatctgtcggatgacgggtttaagattaagcctgagcgtaaaacggatgatttgaaggcttggcagaatgcggatgttgttcgcacggttgctaccgagtcttctatcgagatttctttccagctgatcgaatccaaaaaagaggttatcgagctgttttggcagtcgaaggttactgccggatccgattcgggttcgttcgatatttctccgggtgccacgacgggtgttcacgccctgttgatggatattgttgatggggatcaggttattcgctactatttccctgaggttgagcttatcgatcgtgacgagatcaagggtaagaatggtgaagtgtacgggtatggtgtgacgttgaaggcttatcctgcccagattaataagactggtaatgcggtgtcgggtcgggggtggatgacggctttaaaagctgatactcctccggttcctccttccccgaagcctccgaagcctgagccggatccgaatccgccgtctaataactgatacacatagtttgagggattgttgatagatgagtgatacaggttacacattaaagatcggtgaccgtagctgggtgttggcggatgcggaggagacggctcaggctgttcctgcccgcgttttccgtcgtgcagctaagattgcccagtcgggggagtctgcggatttcgctcaggttgaggtgatgttttctatgttggaggctgccgccccggctgacgcagtggaggccctggaggggcttcctatggttcgtgtggccgagattttccgccagtggatggaatacaagcctgacggtaagggtgcctcgctgggggaatagtttggctccacggcctgattgatgattatcgtggggccatcgaatacgatttccgcaccaagtttggtgtttctgtttatagtgttggtggcccgcagatgtgttggggtgaggctgtccggctggctggtgtgttgtgtaccgatacgtctagccagttggcggcccaccttaatggttggcagcgcccgtttgagtggtgcgagtgggcggtgttggacatgctggatcattacaggtctgctaatagtgaggggcagccggagcctgtggcgaggcctacggatgagcgtagggcccggtttacgtctgggcaggtggacgatattttggcgcgtgttcgtgccggtggcggggtgtctcgcgagattaatattatggggtgaatagtgtatgtctggtgagattgcttccgcatatgtgtcgttgtatacgaagatgcctggtttgaaggctgatgttggtaaacagttgtctggtgtaatgccggctgagggtcagcgttcgggtagtctttttgctaagggcatgaagttggctcttggtggtgccgcaatggtgggtgccatcaatgttgctaagaagggcctcaagtcgatttatgatgtgactattggtggcggtattgctagggcgatggctatcgatgaagctcaggctaaactgactggtttgggtcacacgtcgtctgacacgtcttcgattatgaattcggctattgaggctgtgactggtacgtcgtatgcgttgggggatgcggcttctactgcggcagcgttgtctgcttctggtgtgaagtctggcgggcagatgacggatgtgttgaagactgtcgccgatgtgtcttatatctcgggtaagtcgtttcaggatacgggtgctatttttacgtctgtgatggctcgcggtaagttgcagggcgatgatatgttgcagcttacgatggcgggtgttcctgtgctgtctttgcttgccaggcagacgggtaaaacgtctgctgaggtgtcgcagatggtgtcgaaggggcagattgattttgccacgtttgcggctgcgatgaagcttggcatgggtggtgctgcgcaggcgtctgggaagacgtttgagggcgctatgaagaatgttaagggcgctttgggttatctgggtgccacggctatggcgccgtttcttaacggcctgcggcagatttttgttgccttgaatccggttattaagtctatcacggattctgtgaagccgatgtttgcgtcggtggatcaggggattcagcgtatgatgccgtctattttggcgtggattaatcgtatgccgggcatgatcactcgaatgaatgcacagatgcgcgccaaggtggagcagttgaagggcatttttgcgagaatgcatttgcctgtccccaaagtgaatttgggtgccatgtttgctggcggcaccgcagtgtttggtattgttgcggccggtgtcgggaagcttgtcgcagggtttgccccgctggcggttgcgttgaagaatctactgccgtcgtttggtgctttgaagggtgccgccggggggcttggcggcgtgtttcgcgccctgggtggccctgtcgggattgtgattggcttgtttgcggccatgtttgctacgaatgcccaattccgtgccgctgttatgcagcttgtgggtgtggttggccaggctttggggcagatcatggccgctgtgcagcccctgtttggtttggttgccggggttgtggcccagttggcgccagtattcggccagattatcggtatggttgccggtttggctgcccagctggtgcctttgattagtatgcttgtcgcccggctggttcccgtgatcacgcagattattggtgcggtgacacaggttgctgcaatgttgttgccggcgttgatgccggttattcaggctgttgttgctgtgatacggcaggttgttggtgttgtgatgcaactggtgccggttttgatgccggtgattcaacagattttgggtgcggtcatgtctgtgctgccacctatcatcggccttatccgttcgttgataccagtcatcatgtcgattatgcgtgtggtgatgcaggttgttggtgccgtgctacaggtggtggcccgcattattccggttgtgatgccaattgtgacagctgtgatcgggtttgttgcacgtattcttggtgctattgtgtctgctgcagcccgcattattgggactgtcacccgtgtcattggatgggttgtggcccattttgtgtctggtttggcgcgtatgggttcggttattcaggctggctggaatcatattagggcgtttacgtctgcgtttattaacggtttcaagtcggtgatttctggcggtgtgaacgcggttgtggggttttttgctcggctgggttcttctgttgcttctcatgtgaggtctggttttaacgcggctcgtggcgctgtttcttctgcgatgaatgctatccggagtgtggtgtcttcggtggcgtctgctgttggcgggtttttcagttcaatggcttctcgggttcgtagtggtgctgtgcgcgggtttaatggtgcccggagtgcggcttcttctgctatgcatgctatggggtcggcggtgtctaacggtgtgcatggtgtgctgggttttttccggaatttgcctggtaatattcggcatgctctcggcaatatggggtccttgttggtgtctgctggccgtgatgtggtgtctggtttgggtaatggtatccggaatgctatgagtggcttgttggatacggtgcgtaatatgggttctcaggttgctaatgcggcgaagtcggtgttgggtattcattccccgtctcgggtgtttcgtgaccaggttggccgccaggttgttgccggtttggctgaggggatcaccgggaatgctggtttggcgttggatgcgatgtcgggtgtggctggccgtcttccggatgctgtggatgcccggtttggtgtgcgatcgtctgtgggctcgtttaccccgtacgaccggtatcggcgtgcgagtgagaagagtgttgtggtgaatgtgaatggcccgacgtatggtgatcctaacgagtttgcgaagcggattgagcggcagcagcgtgacgctttgaatgcgttggcttacgtgtgattgggggtgtggttcatgtttattcctgacccgtctgatcgttcgggtttgactgtgacatggtttatggatccgctgtttggtggggagcgtgtgcttcatttgacggattacacgggtgcgtctcctgtcatgttgttgaatgattcgttgcgcggtttgggtgttcccgaggtggagcatttttctcaaactcatgttggggtgcacggctcggagtggcgcgggtttaatgtgaagcctcgcgaggtgacattaccggttttagtgtcgggtgttgacccggatccggatggcgggtttcgtgacggttttttgaaggcgtctgacgcgttgtggtctgcgtttcctccgggcgaggtaggggagttgtccgtgaagactcctgccggtgttgagcgtgtgctaaggtgtcggtttgattcggttgatgacatgtttacggttgatccggttaatcgtggctatgcgcgctatctgttgcatttgacagcttatgatccgttttggtatggggatgagcaaaagtttcgttttagtaacgcgaagttgcaggattggttgggtggcggccctgtcggcaaggatggtacggcgtttcctgtggtgttgacgcctggtgttggttcgggttgggataatctgtctaataagggtgatattcctgcgtggcctgtgattcgtgttgaggggcctttggagtcgtggtctgtgcagattgatggtttgcgtgtgtcttctgattatcctgtcgaggagtttgattggatcactattgatacggatcctcgtaaacagtctgcattgttgaacgggtttgaggatgtgatggatcgtttgaaggagtgggagtttgcgcctatcccgcctggcggttctcggagtgtgaatattgagatggttggtttgggtgccattgttgtgtcggtgcagtacaggtttttgagggcttggtgaatagttgatggctggtcttgttccgcatgtaacgttgtttacgcctgattatcgccgtgtggcgcctatcaatttttttgagtcgttgaagttgtcgttgaagtggaatggtttgtcgacgctggagttggtggtgtctggggatcattctaggcttgacgggttgacgaggccgggtgcacggctggttgttgattatggtggtggccagattttttctgggcctgtgcgtcgggttcatggtgtgggtccgtggcgttcttcgcgggtgactatcacgtgtgaggatgatattcgcctgttgtggcgtatgttgatgtggcctgtgaattatcgccccggtttggtgggttcggagtggcgtgcggacagggattatgcccactattcgggttcggcggagtcggtggctaagcaggtgttgggggataatgcttggcgtttttcgcctggtttgtttatgaccgatgatgagagtcgtggccgctatattaaggattttcaggtgcggtttcacgtggtcgccgataaactgttgccggtgttgtcgtgggctcggatgactgtttcggtgaaccagtttgagaatgtggtgaaggatcagcgtggtttggtgtttgattgtgtgcccgcggtgacgcgtagccatgtgttgactgccgagtcgggttctattgtgtcgtgggagtatgtgcgtgacgccccgaaggctacttcggtggtggttggtggccgcggcgaaggcaaagatcggctgttttgcgaggatgttgattcgatggccgaggatgactggtttgatcgtgtcgaggtgtttaaggatgcccgtaacacggattctgaacatgtgcatctcatcgatgaggctgagcaggtgttgtccgagttaggggccacgtcggggtttaagatcgagttggccgagtcggatgtgttgcgttttgggccaggcaatctgatgccaggggatttgatttatgtggatgtgggctcggggcctattgaggagattgttcggcagattgatgtggagtgtgattcgccgggtgacggctggacgaaagtgacaccggttgcgggggattatgaggataatccgtcggcgttgttggctcgccgtgtggctggtttggctgcgggtgtgcgggatttgcaaaaattctaattgttgggggtttgttgtgggtattgtgtgtaaagggtttgatggtgtgttgaccgagtatgattgggctcaaatgtctggtctgatgggtaatatgccgtcagttcatgggcctgacgattttcgtgtgggcactactgttcagggtgctacggtgttgtgtgaggtcctgccggggcaggcttgggctcacggggtgatgtgcacgtcgaatagtgttgagacggtgacggggcagctgcctggtcctggtgagactcgctacgattatgtggtgttgtctcgggattgggagcagaatacggccaagttggagattgttcctggggggcgtgcggagcgtgccagggatgtgttgcgtgccgagcctggcgtgtttcatcagcagttgttggctactttggtgttgtcgtctaacgggttgcagcagcagttggataggcgtgccgtggcggctagggttgcgtttggggagtctgctgcgtgtgatcctacccctgtggagggtgaccgtgtgatggttccttcgggggctgtgtgggctaaccatgctaacgagtggatgttgttgtctcccaggattgagacgggttcgaagtcgatcatgtttggcgggtctgctgtgtatgcttacacaattccgtttgagcgcccgtttggtagtgcgcctgttgtggtggcgtctatggctacggcggctggtggtacgcagcagattgatgtgaaagcctacaatgtgactgccaaggattttagtttggcgtttattacgaatgatggttcgaagcctaacgatgtgcccgcaatagctaactggattgctgtcggcgtgtgactgtacaggtgttgtggcggatgttgtaatgttggggggctgtggtgtcgtggtttactcctgcactggtggcctctatctgtaccgcgttggccacgattttgggttcagttcaggcggtcacatctaaatcgaggaagcgtttacgcaggctatctgcgcaggttgatgcgatggaagagtatacgtggggtgtgcggcgtgaggtgcgccggtttaacgcgaggcttcctgatggggtggagcctatgcatcttcctgatttgcctgagtttttgaaagatactgttgagggtggaggtgagtagggttgagggagttggaggaggagaagcggcagcgccgcaattttgagaaggcttccctggtgttgctgttcctgtcgcttgtgctgttgacggtggttgccgggggtgctttgcgtttcggatcgctgtcttctgagcgggattctgagcaggcgagggcccagtcgaatggtacagccgctaaggatttagccaaccgtgtgcggcaggtgtgtgcgcagggcggccaggagtcggtgcggcttcaccggtctggtttgtgtgtggatgcggtgcgtgttgagcggagtgtgcagggtgtgcctggccctgccggtgtgcgtggccagcaagggcccgccggtgctgacggccgggatggcagtaatggttcggctggtgttgttggccctgttggtccgcagggttccccgggtttgaatggtgtgaaaggacctgacgggttgcctggggctagcggcaaggatggccatgatggtgttccgggccgtgcaggtgttgacggcgttgccggggttgatggtaaagatggtgcgaatggcgccgatggtgagcgcggtgatgtgggcccttcaggtcctgccggcccgcaaggtgcacagggtgaacggggtgagcgcggcaacgccggtgcgaacggatccgagggtaaagacggtaaggatggccgttccgtggtgtccgtgtactgttctgagggtcgcctggttgtgaaatatagtgacggtgtggcttctacaatatcgggctcggtggcctgccagggtgtgaggccgtcgcctatagtgaccatatcatcccacaaatagaaaggagtggctgtgatggtagtgtttggtggtggtgtgtggtgaggtttattcctgcggcgcatcactcggccggttcgaatagtccggtgaaccgggttgtgattcatgcgacgtgcccggatgtggggtttccgtctgcctctcgtaaggggcgggcggtgtctacggcgaactattttgcttccccatcgtcgggtggttcggcgcattatgtgtgtgatattggggagacggtgcagtgcctgtcagaggggactattggttggcatgccccaccgaatccgcatagtttgggtatagagatttgcgcggatgggggttcgcacgcctcgttccgtgtgccggggcatgcttacactcgtgagcagtggcttgatccgcaggtgtggcctgccgtggagagggcggcggtgctgtgccggcagttgtgtgacaagcatggtgttccgaagaggaaactgtctgtggccgatttgaaggccggtaaacggggtgtgtgtggccatgtggatgttacggatgcgtggcatcagtcggatcacgatgatcctgggccgtggtttccgtgggacaaatttatggccgttgtcaacggcggcagtggagatagtggggagttaactgtggctgatgtgaaagccttgcatgatcagattaaacaattgtctgctcagcttactggttcggtgaataagctgcaccatgatgttggtgtggttcaggttcagaatggtgatttgagtaagtgtgttgaagccttgtcgtgggtgaagaatccggtgacagggaagctgtggcgcaccaaggatgctttgtggagtgtctggtattacgtgctggagtgtcgcagccgcatagacaggcttgagtcgactgtcaacggtttgaaaaagtgatggtggtttgttgtgggtaaacagttttggttgggcttgtttgagcgtgccctgaaaacttttattcaaacgtttgttgctgtgttgggtgtgacggcgggtgtcacgtatactgcggagtcgtttcgcggtttgccgtgggagtctgccctgattacggccggggttgctgcaatactgtcggttgctacctcgtttggtagcccgtcgtttgtggccggcaaacctaaaaccacggttgtggatgctgagcttgttccacccgacgatgggggcatggttgagccgcactcggtggatgtgtcggatcctggcatgatcgagccgacagatgatgttgatggttttgccggctatgtgccgaggcgtgccgccgagtcggaggttggcacggtagagtctactgttgcataattgaatatgtgtgtgtgccccagcggtgctgccacgatcgtgtggtggttgccgctggggcactatttttgtgtctatagtattctatgattcgttgttgttgatggtttcctcaatcgtctgatacaggtggaggcaggtagagatagtttcgttggcctggtctagaacgttctggccgataacatttttgtggttgtcgcggtggcagatgatagaccgcatgatatcgtcggccgcagattgtagtagtttggtttggtatgcgattccggcgagccagtctatggcttcctggcttgccagtgtgtcgtctggaatgtcactggtgttgctgttgtttgtggggtatcctgcactgtcgcagtcccacaagatttcgctgcactcgtctagcgtgtcctggtcgatgtcgagattgtcgaggctgatttctttaacagtaaggttcacgttgtcgagggagatgggtacactgtactggttttcgacaccgccaacaatgttttctagctgttgcatgttggtgggctgttgttggatgattcggtgtaccgctgttttgagggcagtgtaggggatattggttatgttgttcatggttttatcccatccctgtgctgtcgtcgctatcgtctggatagtatctactgtttgcgtagcctgtgagggtgatgagtgtttggtctgcccactgtttcacggtttgtcttgtcaccccgagccgttgggctgccaccgaataggtttgatcatacccgtatacttcacggaatgctgccaaccgtgccaaatgttttcgctgtttggatggctggcaggtgagggtgtagtcgtcgatggctagctgcaaatcgatcatggtgacaatgttgttgccgtggtgttgtggcgcggttggtggtggtggcattcctggctcgactgatggtttccatgggccgccgttccagatccattgggcggcttggatgatgtcggcggtggtgtaggttcggttcatgtgtcatcccctgaataggttgtcgaggttgtctgggttgctggtgttggtggtgtcgaatcgtccgacgcagtggcagtagtcgtacatgagtttgataatgtgttggtggtcgccgaggtaggtgtttccgctgatactgtaggtggctgtgccgtctttactgatggtgtatttggcggtgatggtttcgggtgtttgggtgttggtgatgatggcggtggtggtggcgcctactgtttggagtatggtggtttgggttccgtcgtcgagggtggttgtgaccattttggggttatccttttagttgctggtttgtgtgtcggctagatgaatgatatcggataaaggtttcggttggtctaggtgttgtatggttttgttggctagccgtttggctaccctgtagcatattttgatgtagtgtttgttgtctaggttgtggtattgttcccgcaccgcaatatatagtagggagtcttggtacaggtcgtctgcactgattgcggggtagtgtgtggctactttggtgcatgcccggttgagtgtgcgaagatgatggtttgtggcccatacccacgatgcggtggtggccaggtctgcttttgttggtcgtctgctcatggcactatctcatctcgctatctggtagttgtttggtgttttgttgtggatagtgtagcacactagtccggggtggccggtggtgcctgtgcggtgccgaaaccatgtggattcgccttccatggatgggcattggatgaaggtgcgttgtccttgctcggagatttctaggtggtgccggtgccctgccatgaggatgtgggatgtggtgccgttgtggaattcttggccgcgccaccattcgtactgtttgccggttttccattggtgcccgtgggcgtgcaggatttgtgtgccggccacatcaacggtggtggtcatttcgtcccggctggggaagtggaagtgaaggttgggatattggttgttgagctggtaggcttctgcgatggcccggcagcagtccacatcgaaggagtcgtcgtaggtggtgacgcctttaccgaagcgcacggcttcaccgtggttgccggggatggatgtgatggtgacgttggcgcagtggtcgaacatgtggatgagttgcatcatggccatgcgggtgagcctgatttgttccgtcaggggtgtttgggtgcgccaggcgttgttgcctccttgtgacacgtatccttcgatcatgtcgccgaggaatgcgatgtggactcgttgcggtttgcctgcctgttgccagtagtgtttggcgactatgagggagtgtaaatagtcgtcggcgaagtgtgctgtttctccgccggggatgcctttgccgatttggaagtctcccgccccgatgacgaaggccgcattgctatagtcggtgtgggtgtcctgttcgggttttggtggctgccagtcggctagtttatcgacgagttcgtccacgggatacgggtttgttgcgggttggtggtcgatgattttttgtacggatcggcctgtttctccgttggggagtgtccattcggagatgcgtgtgcggcgtacagtaccattggctagattgtcgtcgatggtgtcgatggcgttgtcgtggttggctagctgtgtgagtagccggtcaatattgtctatcactggttttcctcctcttgcggggtggtgttggcttgtttacggcgatagtcttttataacggtggcggagatggggtatcctgcctgggtgagctgttttgctagccacgaggcggggatggttttgtcggcgagcacgtcggcagctttgttgccgtagcgttgaataagggtttcagttttggttgccatgatgtcctatcggttgtgtggtgggctgccatcctgtgcgacagtcgccgtcgtgtcctggtttgcgggtgcaccacgatacggttccgtctgtgtggttgagtgttttaccgcacatgacgttttgtagatgctccggcagctcgctattgctatcgtcttgctcgtctagcaaagttttttgttgggtgaaaaactcggacacggtgccgttgtggactgggagtatccatgttttccattgttgttgtagccgggtgttccagtggaattgttttgctgcgttcgtggcttgtttgatggttttgaaatagcctacaatgatccgttgatggtcactatcgggcttgtgtggccctttccaatattgggcagctacagcgtatttgatgttgtctgtgaagcgcccccagcagtattccaccatgtgtgatagtaccttgtcgggcatgtctcgtacttggttttcgtcgagccactcgtcgacaataatgttgcgtatggctcgcttgtctttggtggtgggcttgaatgctatgctcacaatgctggcctgtcgtcttgcatgaaatcattaaaggatgattcgcttgtgcggcgtgcttgcgtgatttgctggtcagtccagtcggggtgttgctgtttcaaatagtaccagcggcacgcattgtaggtttcgtcttggagccgtgtgagattgttttcggtgatgatttgtttccacattgtccatgacacgtcgagccggttgaggatttcgagggctgggatgttgaattggtcgaggaagaggatttcgtgggtgtagtagtttttctcgtattggtcccatccgcttcggtgcctgttgggctggtttttggggtaggcttcccggcagattttgtgtaaccgtttggccatgtcgtcgggtagtttaatgtcggggttggcgcggatcatggatcgcatcccatcataggtggtgccccaggtgtgcatgatgtaggtggggtcttcgccatcagcccatttttctgcacagatggcgaggcggatgcgcctcctggctgtttggctggtgttgcgccggttggggattgggcacgtgtcgaggggatccatgatgttttagtgtacctttctggtttcgtgttgttgacgtgttttactgtagcacagtgtctagtgcttgtgtcaaccctgtttttccggcctgaaggtaggtgtctgtgacatcccccagggtgaggggcacatgggtggcttgggggagtgctgcctggagggtttgcgccatcttgtctcccgcggggtctgggtcggaccatatgtagatgtggtcgtagccttcgaagaatttggtccaaaagttttgccacgaggttgcgccgggtagggctacggccgaccatccgcattgttcgaggatcatggagtcgaattcgccttcgcaaatgtgcatttcggctgccgggttggccatggcggccatgttgtagatggagcctgtgtctcctgccggggttaggtatttggggtggttgtgggttttgcagtcgtgcgggagtgagcagcggaaacgcatttttcttatttcggctggctgcccccaaacggggtacatgtaggggatggtgatgcactggttgtagtcttcatgacctggtatgggatcattgtcgatgtatccaaggtggtggtagcgggctgtttcttcgctgacgcctcgcgctgagagcaggtcgagtatgttttcgaggtgggtttcgtagagggctgaggctttctggattcggcggcgttccgcaatgttgtatgggcgtagtgtgtcgtacattcgggttttcttcttctaatcgttgttgtagcttggcgagtccgcctccgacaccgcatgtgtggcagtaccagacgcccttgtcgaggttgatgctcatggagggctggtggtcgtcgtggaacgggcagaggatgtgttgctcgtttcgtgacggattgtagcgtatccggtagatgtcgaggaggcggcaggtgtcagaggtgtgggaggagctcgttgagggttgataccacataggcttcgctccatggcttgttgcgctgtttcatcactacgagtccgatggtggaattgttttgtttgtttcggtgtgtttcgtagttgcgtgcctcccggctggcttgtttcacgaattgggctaggtgtggttgcccggctttcgcctcgatcacataggttttgttgccggttgtgaggatcaggtctccctcgtcttcgcggccgttcagatggaggcgctcgatatcgtgtccggtgtcgcgtagctggtgcaataatcgtgtttcccattcggctccggcccggcggttgcgtgcctgttgtgtcgccatcatagtcctttgtgtgttttggtcatgttccatggctgtttttcggcgagtggcccgaagaatgtgtattctgggtaggctcgtagccgctcgtatcgggtgccgtctgggctggatcgcccggtgcgctgtttcaacactgcgatgcgtgcctctgccgggatcgatagcccgttgccgttatcctcgccaccatacaatgagactccgaggatgagttgtggtttttcggagaggccgtttttgatttccctgcgtgccggggggtgttcgatgtcggagccggttttgtcggtggcgtggtgggtgacaataatggtggagcccgtatctctacccaatgctgtgatccattgcatggcttcttgctgggcctggtagtcactctcgcagtcttggatgtccatcaggttgtcgataacaatgagtggtgggaaggtgttccacatttccatgtaggcttgcagttccatggtgatgtctgtccaggtgatgggtgactggaatgagaatgtgatgtgttggccgtggtggatgctgtctcgatagtattctggcccatagtcgtcgatgttgtgttgtatctgtgtggtggtgtgttgggtgttgagtgagatgattcgtgtggaggcctcccagggtgtcatgtcccctgatatgtagagggcgggctggttgagcatcgctgtgatgaacatggctagccctgatttttggctgccggagcgccccgcgatcatgactaggtcccctttgtggatgtgcatgtccaggttgcggtagaggggttctagctggggtatgcggggcagctcggctgcggtttgggaggctctctcgaaggatcgttggagagagagcatcggagcctttatctatctgtctatcggttggatgttgttttggtggtcagatggagtcgatatcgatgtcagcatcagcaggggctgtggtgtcgtctagctggccgttatcgcgcttgtctacgtattcggcaaccttatcgtagatggcgtcgtctaatggtttgagcacgaccgcgttgaacccgtttttggtgcgtacggtggcgagtttgaaggcctgctcctcgccaaggtaggtttctagatcgcggatcatggagtgtggacggtcgttgttgccgcgtgctttctcaatgatagcgttggggatggtttctggggtgccgttattgagatcctcgagggtgtggaagatggtgacatcagcgtagatgcggtctgcgacctgtccaccgtagccttcggtgttgtgttctacgtcgcggactttgaaggcgatggcggtggcgtcctggtttcgggacgggttgaagaaggtgctgttgctgttgttgcggtagttggcaagtcccattattgtatcctttactgttgtgtctgttattgttggtttctgttggttatcgggtgaggctgtttcgtttgctgcggaaagcctcggaaacgtcactgttactggtgatgatctttttgtactgttttagaaggtcggctagctgtgtcttgcttgttgcattgttgattttgttgatgacgatggtgttttctttggatgcgatgttgtccacgtagtctttggcggcctggttgtatcggtcttggaggatgatggatgcgctcgctacgagtgttgctagatcccagtctttggacacgtcatcgtttttgagtccgcccaataaatcgatgatggcctgttttgtctgctctgctgtgtctcctcggatgaccgcccatggtgcagcatagtctccaccatatttgagtgtgatcgtgagtcgatcattgtcgatcttgtctttatcggtcatttggtgtccttttctttattgtctgtttggggtggctgtacggtggattctaccgggtacctgtaggcgtctttgccgtctacagcccagcaggcgtccttgacagggcatcctttgcagagtgtggtgacgtgtgggacgaagatgccttcgctgattcctttcattgcttgactgtacatggatgatacatgccggtaggtgttgttgtcaaggtcgtagagttcggtggatgtgccttgtgtcggggacttgtcgtcgttgcggctggtggctggcgtccaaaacatgcctttcgtgacattgatgccgtgttgggcgagcatgtaccggtaggtgtgcagctgcatactgtcggcgggtaggcgtccggttttgaggtcgaggatgaatgtttcgccggtgtcggtgtcggtgaaaacgcggtcgatgtagccgactatttttgtgtcatcgtcgaggatggtttctaccgggtattcgatgcctggtttaccgtccaggattgcggtgatgtattctgggtggttgcgcctccatgttttccagcggtccacaaaggtggggccgtaaaccatccaccagtcgtagtctttcttgtgtggcccgcccgactcgcacatgtttttgcatattcttccggagggtttgatttctgtgccttcggattcggcgagggcgacttgggtgtcgaaaatgtttttgaaggatgcgagtttgtctggtagtgcagggtattcggcgggattgtacaggtgtagatcgtattgttcggtgatgtggtgtatggcgcttccggcgatggtggcgtaccaggtgtgataggtggctttgtatccgtgttggaggcgccatttttctccgcattcggcccactgggtgagtgaactgtaggagatgtggcctggatggtggatggttttcgggtattgtgctagaggcattatttgtcgcttttgttccatgggttgcgggtgtcttggccggcgtggtgttgctggtatgcgaggagtgcgaggcagtgccaggcggcgtgggccagatgcgacaaatgtgattcctggtcgaggttgtttccttgctgccatgatagtaggtggcggtagagggcgtcgacactgtggctccacgggtatcctccggtccagttgttgtcgccgtatttggtggcaccgtagcctgctacttcgccgagagcgtgaagggatgcggggtcgatgagggagagcctgcagagtttcaattcttttcgggcaccggtgttggggtcggtgtacatgcgggtgggctcatccatgagatgtgtgctccttaagggtgggttactggttgttgttgtgggcgagtgctactgcgagaataatgatggcgagggtttcagcgatcagtatgggtgttgtgatcatttgctgtctttgggcttgtatgtgagtgttgatgcacccaggagggtggcgagggcgcatgcggcaataatggcgagggctgccttgtgtggggtgccggttgcgtacatccatgtgatgatgccgccttggatccaggcgaggctggtgaagaacgtttcgtagctgtgtagctcaatgttgttgttgggtgtgttcatgcttgctcctgaagaatggtgttgatggttttataaatgttgtacaggtcggtttcgatagataacagttggttgatttggtggtcgaggttgatgtctgggttgagggtgttgatgcgggatgcgatgtcggtggctgtgcgtagtgtgccgccggtgtggtgaataatgtgtgccgtgtcggcgagtccggtagtgacagcgtagtgggagaggagaggcatagcggtgatgctccttggcgggttactgttgcgggttgatgttgaggtcggtgacgtgctggtggtcttctgttccggtgacgaggcagtggacggtgacgggtagtttggatgcgccgggctgtttcgcggttgcgccgtagacgatgctgaatgtgtctttaccgatggttttgtggagttggaggtcgatgtcggggttgccgttccagttgacaccttgtgcggctgcctgttgttcggctttgtggttgcaggtgtgtgctgccgtgatcatggtgagtccggtggcggtttcttcaccccttgcttgggcttgcttgtgggctttctgctgttcggcttgtagggagcgggtggcggcggcctggcgggccttcttctcggctttgcgctgttgggtagtcttgggggtccattcggtgttggctgtggtggcctgtggggctggctgtgaggcgaggggcggattgtcgtctggggctggcatgaatgaggcggcggcaatgatggcggctgtgatgccggcgatggtgtagccgtttttcttgttcatgttttgcttcccctttccggggtgttgttcgttgctgacatgatcaatgatggtgtgggcggtggcccatgtcaagggtgcgctcaacgattgtgagcgatgcttgcgtggctaggtgttttatcgggcacacagggtgagtaggtggccaacattgatgcgggtcacgttccaatagagttgcgtggcttcaccgccggtgagcggcttccactcatcatggctgaacacggtgccgtcggtggctatgaatgtgttggggcgtagcttgtggagttcggcttccacatgctgccggtaggcttcggcaaggccctcaaaatcgaggtgttcgcaggagaggttttcgaggcgtgtcaggtcgaaaggtacggggcagtcgtagctggctggggtgtaaagctgggtgaaatggttggcgatcttctgcataataggtttcctttcgtgtgatgtgttggtggttttatcgggttactgcggcgatgatggcgtcgaggtcgatcgtgtcgatcatgtcgtggagttcctcactctcgccctcggtgagtgactgccagttgcgtggcccatacactgcaccgtcgagagtgacagtccagtctggccggatgagtcgtatggcttcttgtactttagcatggtacatgcggcgcaccatatcgagatcgatgtcgtctgaatggtttccggtgaggctgtggaggctgagcgggtcgatttctgtctgcctgtagagggatgtgaaggatggggtgatgagtgtgtcatccattggtgtgctcctttccggggatgctgatgtatgggttgttgtggtttctagagtgtgtaggttgcgaccccacagtcaaggctgcgctcaatcggattgagcgtttcatgctggagtgtggggtgtgacagatgtcacttaagcctttattgcctctctcggcgtctcaaatcttctaggggtaggattatgcagggttgaccctgctgatcgattctagggcccttctagggcgtctcaggggtatgtctgggtgatagcgggtgtgacagatgatccagcgagtcaaggtgccgagcttagacataagatctatcatctaggtgtgtgagatgtatcacatcctcctggcttggtgtgtactctcaagactactctgccgatctggcgtggagggtgtagcccagaaatgccgtttaaagccttcacacggcgcctaggagcgccttgcagggtgggggctaggtatttatacccccagcatattctgatcgattctagatgcctccaggagcatgatacacgatcagccatcaagacgcagctcatcagcccctatcctgcttagctaagcctacactatgtggacagtgtggaatgctaagagggaagaaggacgcggtaaaagaaagaaggggagcatcagccttcacacctgaggcacttaagttaaccttagggtcttagcactgagcatttagcaccgagcccctcaagggctcggcatcagcccgagcaggctcagccctgaaaggagtacacgccatcagggaaggcttgagagtatgaggagcctcagcgacgagtactcgaaagcctgagggaagaccatcagcactgatgggcctagcgtgttcggaaaagacacaggagtacagtatgacaactgtccgggagtgaaaccccttccggctagggcaaacacccgtcctagactagcccacacccttagctgttaaccttccgttcattaaacgttaaggaaacttttaggtttgatttttggacctttaccaccaaaaacacccttttacacccctcaaacccgcctatagagccaaatccgccagtttgactcatcccaggtggcatatgataggctggacaggtagccagctggacgcaaggccggaaagtgctgacgcacttcccaacctcgcttaccatcagtctaccaaagacttaaagacctaagggcttagcgctaaggtgctgatagcttagcaccgagcccctcaagggctcggcatcagtcttaggtacttaaagtaactttaaagacttaaagtaaatatataaccttagcagttaaacgtttaaagctttaaaccttaacacctaagttaagtataaaaccttaaaggcttagcacttaaggatataaacttaaagagttagaataaccataaagatttaaacacttaaagtaactataggactttaaaaaccttaagtacctaaagttaaccatcagtcttaaactttaatgttataacctataagtcttaaagcttataggtataataatataatataattatataagtattaaagcttataagttataaaagttttagaagagctaagaggttaaattctttacttctctactctctttggttctttctctcttctcttcttttcttcatcaggggagaagaggaacctttaccatcagcgctgatggtcttttcgccgtgtgtctcgtgtgcttggtcgcaagctcccggttacacactccccacactctctttcacctgtgtccctttaaggcttggcgtgttcggctgaaggcgtacggcgtgtcacgggaacacccttaacaccaggtaagacttaaagtgtatattatatgtagaagactttaaaaactttgagagtgtacccttcttggctgtgttctacaccgctaggcgccaagcgctaagccttgaaacgcgaacacacacccacccccatttttcttccgcgtccttcttcttttgacacagctggggggcgatgtgatctttctcacacccatgggggtagtggagaaaacaaacaccccggaacgttcaagacgccccctcaaacgcacaaaacagggcctagaatcgatcagcagggcaagggcaaggtattcatacccccaacggtttccaggccgttacagaggcaaacaagacccgtacagggctagccgaggatcggagacgtgatggcacacaccaaccgcaccgcatcctccgcccaccgccgatggcgagcacgactcatcacccaagcccgcaaacaaggacaaaccacctgcccactctgcggaaccgagatcgcctgggacacccacgacctaccaaccagccccgaagccgaccacatcacacccgtcagcaggggaggactcaacaccctcgacaacgggcaaatcatctgcagaacatgcaacagaagcaaaggcaatcgcagcgaaccaaacatcaaattccaacaacaaaccacaaaaacattgattccatggtgaaaaacccgccaacccccaccgggcacaccccctgcacacccgtgcaagacc

SEQ ID NO: 42 - DNA, 29377 bp, Unknown
  source: /note="Description of Unknown: Bacteriophage of P. acnes"
agtgaaatacctcccttttgtggttttgtctgtttgtcgactttttgtgttggtggtgagtgttgtgcagcctgagcttcctgatagtcgtgagtggtgtggggagacgcgtcgttggtggcgtgtgtggggtgaggatagccgcgcatcgtacgtgtctgatgaggagtggctgtttctcatggatgctgcggtgattcatgatgtggtgtggcgtgagggtcgcgcggatttggtggcttcgcttcgtgctcatgtgaaggcttttatgggtatgttggatcggtattcggttgatgtggtgtctggtggccgtggtgggggttctgcggtggcgatgattgaccggtataggaagcgtaggggggcctgagtaggtgtctggtgttgttgggtctcaggttcctcgtcatcgggttgctgcggcgtattcggtgtctgctggcggtgatgctggtgagcttggtcgtgcgtatgggttgacgcctgatccgtggcagcagcaggtgttggatgattggcttgctgtgggtggtaatggcaggcttgcttcgggtgtgtgtggggtgtttgtgcctcgccagaatggcaagaatgctattttggagattgtggagttgtttaaggcgactattcagggtcgccgtattttgcatacggctcacgagttgaagtcggctcgtaaggcgtttatgcggttgaggtcgttttttgagaatgagcggcagtttcctgacttgtatcgtatggtgaagtcgattcgtgcgacgaatggtcaggaggctattgtgttgcatcatccggattgtgccacgtttgagcgtaagtgtggttgtccgggttggggttcggtggagtttgtggcccgttctcggggttctgctcgcgggtttacggttgatgatttggtgtgtgatgaggctcaggagttgtcggatgagcagttggaggctttgcttcctaccgtgagcgctgccccgtctggtgatcctcagcagatttttttgggtacgccgccggggcctttggctgacgggtctgtggtgttgcgtcttcgtgggcaggctttgtcgggtggtaagaggattgcgtggacggagttttcgattcctgacgagtctgatccggatgatgtgtcgcggcagtggcggaagcttgctggtgacactaatccggcgttgggtcgtcgtctgaatttcgggacggtgagcgatgagcatgagtcgatgtctgctgccgggtttgctcgggagcggcttggctggtgggatcgtggccagtctgcttcgtctgtgattccggcggataagtgggtccagtcggctgtgggtgaggcgagccttgttggcgggaaggtttttggggtttcgttttctcgctcgggtgatcgtgtcgcgttggcgggtgctggtaaaacggattctggtgtgcatgttgaggtgattgatggcctgtcgggcacgattgttgatggtgtgggccagctggctgattggttggcgttgcgttggggtgacactgaaaaggttatggttgccgggtctggtgcggtgttgttgcagaaggcgttgacggatcgtggtattccgggccgtggcgtggtggttgctgatactggggtgtatgtggaggcgtgtcaagcctttctggaaggtgtaaggtcgggtgtgatcagtcatcctcgtgccgattcgaggcgtgacatgttggatattgctgtgaggtcggctgtgcagaagaggaaaggttctgcgtggggttggggttcctcgtttaaggatggttctgaggttcctttggaggctgtgtctttggcgtatcttggtgcgaagatggcgaaagcgaagcggcgtgaacggtctggtaggaagcgggtgtctgtggtatgaactcggatgagttggctctgattgagggcatgtacgatcgtattcaaaggttgtcttcgtggcattgtcgcattgagggctactatgagggctctaatcgggtgcgtgatttgggggttgctattcctccggagttgcagcgtgtgcagactgtggtgtcgtggcctggtatagctgtggatgctttggaggagcgtctggattggcttggctggactaatggtgacggctacggtctggatggtgtgtatgctgcgaatcgtctatcaaccgcgtcatgcgacgtccaccttgatgcactaatttttgggttgtcgtttgttgcgatcattcctcatggtgatggttcggtgtcggttcgtccgcagtcaccaaagaattgtacgggcaagttttcggctgacgggtctcgtttggatgctggccttgtggtgcagcagacgtgtgatcctgaggttgttgaggctgagcttttgcttcctgatgtgattgttcagatggagcggcggggttcgcgtgagtgggtggagacgggccgtatcgtgaatgtgttgggtgcggttccgttggtgcctgttgtgaatcgtcgccgtacttctaggattgatggccgttcggagattacgaggtctattagggcttacactgatgaggctgttcgcacactgttggggcagtctgtgaatcgtgatttttatgcgtatcctcagcgttgggtgactggcgtgagcgcggatgagttttcgcagccgggctgggtcctgtcgatggcttctgtgtgggctgtggataaggatgatgatggtgacactccgaatgtggggtcgtttcctgtcaattcgcctacaccgtattcggatcagatgagactgttggcgcagttgactgcgggtgaggctgcggttccggaacgctatttcgggtttatcacgtctaacccgcctagtggggaggctttggctgccgaggagtctcggcttgtgaagcgtgctgaacgcaggcagacgtcgtttggtcagggctggttgtcggttggtttcctggctgcgagggcgcttgattcgagtgttgatgaggccgcgttttttggtgatgtgggtttgcgttggcgtgatgcttcaacgcctactcgggcggctacggctgatgctgtgacgaagcttgtgggtgccggtattttgcctgcggattctcgtacggtgttggagatgttggggcttgatgatgtgcaggttgaggctgtgatgcgtcatcgtgccgagtctgcggatccgttggcggcactggctggggctatttcccggcagacgaacgaggtttgatgaatggcttcgggtgctatgtcgaggcttgccgcgactgagtatcagcgtgaggcggtcaggtttgccgggaaatacgctgggtattatgccgagcttggtcgtttgtggcattccgggaagatgacagatgcgcagtatgtgcgtttgtgtgtggagttggagcgtgccggccatgatggttcggcgtcgttggctgccaagttcgtgcaagattttcgccggttgaatggtgtggatcctggtttgattgtgtatgacgagtttgatgctgcggcggctttggctaggtcgttttcgactatgaagattcttgagagcgacccggatagggcgaatgacacgattgatgcgatggcggcgggttttgatcgggctgtcatgaatgctggccgtgacacggttgagtggtcggcgggtgcgcagggtaggtcgtggcgcagggtgactgatggtgatccgtgcgcgttttgtgccatgttggctacgaggtcggattatacgaccaaagaaagggcactcactactggacatactcggcgtcataagcgtggtggtaagcgcccgtttggttcgaagtatcatgatcattgtgggtgtacggtggttgaggttgttggcccttgggaaccaaatagggctgatgccgcatatcagaggacgtatgagaaggctcgtgagtgggttgatgatcatgggttgcagcagtcgcctggcaatattttgaaggctatgcgtactgttggcgacatgagatgatggtttccggttgtgtgccgccggttattggtgcacagggttgtctcccgcacgggggtcaacaatgttgtgttgttttccgcaaggagtgtaaggttgggctatggccgatcagagtgttgaagaacagagtgtcgacaatgatgctgttgagcccggaaagggcgaggacattgttgatgttgtgaaggatgggcaggctgccggcgatgatcatgccggtgatgtttccgtgaaggaggagtcttcttctggcacggattggaaggctgaggcccgtaagtgggagtctcgtgctaaaagtaatttcgccgagttggagaagcttcgcgcctcggatggtgatgcggggtctactattgatgagcttcgccgcaagaatgaggaactcgaagacaggatcaatgggtttgttcttgagggtgtgaagcgcgaggtggctgccgagtgtggcctgtcgggtgatgcgatcgctttcttgtcgggtggcgatcgtgaagcactggtggagtctgctaaggctttgaagggtttgatcgaccatagtagtggtggcgcgggtgtgcgccgtcttgcggggagtgcccccgttgatgatgttaaacgacgtgagggtgtcgcgtttgtggatgctcttgtcaataattctaggagatgatttgtgatggctgacgattttctttctgcagggaagcttgagcttcctggttctatgattggtgcggttcgtgaccgtgctatcgattctggtgttttggcgaagctttcgccggagcagccgactatttttggccctgttaagggtgccgtgtttagtggtgttcctcgcgctaagattgttggtgagggcgaggttaagccttccgcgtctgttgatgtttcggcgtttactgcgcagcctatcaaggttgtgactcagcagcgtgtctcggacgagtttatgtgggctgatgctgattaccgtctgggtgttttgcaggatctgatttccccggctcttggtgcttcgattggtcgcgccgtggatctgattgctttccatggtattgatcctgctactggtaagcctgctgcggctgtcaaggtgtcgctggataagacttcgaagacggttgatgcaaccgattccgctacggctgatcttgttaaggctgtcggcctgattgctggggctggtttgcaggttcctaacggtgttgctttggatccggcgttctcgtttgctctgtctactgaggtgtatccgaaggggtctccgcttgccggtcagcctatgtatcctgccgccgggtttgccggtttggataattggcgtgggctgaatgttggtgcttcttcgactgtttcgggtgccccggagatgtcgcctgcctctggtgttaaggctattgttggtgatttctctcgtgttcattgggggttccagcgtaacttcccgatcgagctgatcgagtatggtgacccggatcagactggccgtgacctgaagggccataatgaggttatggttcgtgccgaggctgtcctgtatgtggctatcgagtcgcttgattcgtttgctgttgtgaaggagaaggctgccccgaagcctaatccgccggccggtaactgattcatttgttgcgataatgtttatgctgtgtgcagggggtggtgttgatgggtatcattttgaagcctgaggatattgagcctttcgccgatattcctgaggggaagcttgaggcgatgatcgccgatgtggaggctgtggctatcagtgtcgccccctgtatcgctaaaccggatttcaaatatagggatgctgctaaggctatcctgcgtagggccctgttgcgctggaatgatactggcgtttcggggcaggtgcagtacgagtctgcgggtcctttcgctcagactacacggtctaatactcccacgaatttgttgtggccttctgagattgccgcgttgaagaagctgtgtgagggtgatggtggggctggtaaagcgttcactattacaccgaccatgaggagtagtgtgaatcattctgaggtgtgttccacggtgtggggtgagggttgctcgtgcgggtcgaatattaacggctacgctggccctttgtgggagatatgatatgaccagttttccttatggtgaaacggttgtgatgcttcagccgactgttcgtgtcgatgatcttggcgacaaggtggaagactggtctaagcctgtcgagactgtgtaccataacgtggccatctatgcctctgtttcgcaggaggatgaggccgccgttcgtgactcggattatgagcattggtcgatgcttttcaagcagcctgttgggggtgccggttatcgttgccggtggcgtattcggggtgtggtgtgggaggctgacgggtctcctatcgtgtggcatcatccgatgtccggttgggatgctggtacgcaggttaatgtgaagcgtaagaagggctgatgggttgtggctcaggatgtgaatgtgaagctgaacttgccgggtattcgtgaggtgttgaagtcttctggggtgcagtctatgttggctgagcgtggcgagcgtgtcaagcgtgcggcctcggcgaatgtgggcggtaatgctttcgataaggcccaataccgtaatggtttgtcgtcggaggtgcaggttcaccgggttgaggctgtggcgaggattggcaccacctataagggtgggaaaaggattgaggcgaagcatggcacgctggctaggtcgattggggctgcgtcgtgatcgtttatggtgatccgcgtgtgtgggctaaacgcgtgctcaaggatgatggctggctgtctgggataccatgcaccgggacagtgccggatagttttgagggtgaccttatttggttggcgttggatggtggcccacagttgcatgttcgtgagcaggtgtttttgcgcgtgaatgtgttttcggatacacctgatcgtgctatgagcctgtcgaggcgtgttgaggctgtccttgcggatggtgtggacggtgaccctgtggtgtactgtaaacggtctactggccctgatttgctggttgatggtgcacgttttgatgtgtattcgctttttgagctgatatgcaggcctgcggagtttgaataagattattgtttttgttttaatgtaattgtttgatatttaatgggggttgtgatggctgcaacacgtaaagcgtctaatgttcgttcagcggttactggcgacgtttatattggtgacgcgcacgcgggtgatactattaagggtgtggaggcggttccttccgagcttacagctttagggtatttgtcggatgatgggtttaagattaagccggagcgtaaaacggatgatttgaaggcttggcagaatgcggatgttgttcgcacggttgctaccgagtcttctatcgagatttctttccagctgatcgagtctaagaaggaggttatcgaactgttttggcagtcgaaggttactgccggagccgattcgggttcgttcgatatttctcctggtgccaccactggcgtgcacgctttgttgatggatattgttgatggtgatcaggttattcgctactatttccctgaggttgagcttatcgatcgtgacgagatcaagggtaagaatggcgaagtgtatgggtatggtgtgacgttgaaggcgtatcctgcccagattaataagactggtaatgcggtgtcgggtcgggggtggatgacggctttaaaagctgatactcctccttctccgaagccggatccgaatccgccgtctgagaactgatacacgattttagggattgttgatagatgagtgacactggttacacgttgaagattggtgaccgtagctgggtgttggcggatgcggaggagacggctcaggctgttcctgcccgcgtgtttcgtcgtgcagctaagattgcccagtcgggggagtctgcggattttgcccaggttgaggtgatgttttctatgttggaggctgccgccccggctgacgctgtggaggctttggaggggcttcctatggttcgtgtggcggaggttttccgtgagtggatggaatacaagcctgacggtaagggtgcctctttgggggaatagtttggctccacggcctgattgatgattatcgtggggccatcgaatatgattggaggacccggttcggttgctcggtttatgatgttggtggcccggtgatgtgttggggtgaggctgtccggctggctggcgtgttgtgtaccgatacgtcgagccagttggcggcacacctgaatggttggcagcgcccgtttgagtggtgcgagtgggctgtgttggacatgttggatcattacaggtctgctaatagtgaggggcagccggagcctgtggcgaggcctacggatgagcgtagggcccggtttacgtctgggcaggtggacgatattttggcgcgtgttcgtgctggtggcggggtgtctcgcgagattaatattatggggtgaatagtgtatgtctggtgagattgcttccgcatatgtgtcgttgtatacgaagatgcctggtttgaaggctgatgttggtaaacagctttctggggtgatgcctgcggagggtcagcgttcgggtagtctttttgctaagggcatgaagctggctttgggtggtgcggcgatgatgggtgccatcaatgttgctaagaagggcctcaagtcgatttatgatgtgactattggtggcggtattgctagggcgatggctattgatgaggctcaggctaagttgactggtttgggtcatacgtcgtctgatacgtcttcgattatgaattcggctattgaggctgtgactggtacgtcgtatgcgttgggtgatgcggcttctactgcggcggcgttgtctgcttcgggtgtgaagtctggcgggcagatgacggatgtgttgaagactgtcgccgatgtgtcttatatttcgggtaagtcgtttcaggatacgggcgctatttttacgtctgtgatggcgcgcggtaagttgcagggcgatgacatgttgcagcttacgatggcgggtgtccctgtcctgtctttgcttgccaggcagacgggtaaaacctcggctgaggtgtcgcagatggtgtcgaaggggcagattgattttgccacgtttgcggctgcgatgaagcttggcatgggtggtgctgcgcaggcgtctggtaagacgtttgagggcgctatgaagaatgttaagggcgccctgggttatcttggtgccacggctatggcgccgtttctgaacggcctgcggcagatttttgttgcgttgaatccggttatcaagtcggtgacggattctgtgaagccgatgtttgctgccgtcgatgctggtattcagcgtatgatgccgtctattttggcgtggattaaccgtatgccgggcatgatcactcgaatgaatgcacagatgcgcgccaaggttgagcagttgaagggcatttttgcgagaatgcatttgcctgttcctaaagtgaatttgggtgccatgtttgcgggtggcacagcagtgtttggtattgttgctgcgggtgttgggaagcttgttgcagggtttgccccgttggcggtgtcgttgaagaatctactgccgtcgtttggtgctttgaagggtgccgctggcgggcttggcggcgtgtttcgcgccttgggtggcccggtcgggattgtgatcggcttgtttgctgccatgtttgcgactaacgcccagttccgtgccgcggtgatgcagcttgtggctgtggttggtcaagccctggggcagattatggccgctgtgcagccgctgttgggtttggttgctgggctggtggcacggttggctcccgtgtttggccagattgttggtttggttgccggtttggctgcccagctggtgcctttgattagtatgcttgttgctcggctggttcctgtgatcacccagattattggtgcggtgacacaggttgctgccatgttgttgcctgcgttgatgccggtgttgcaggctgttgtggctgtgatacggcaggttgttggcgtgatcatgcagttggtgcctgttttgatgcctgttattcagcagattttgggtgctgtcatgtctgttctgccgccgattattggcctgattcggtcgctgataccagtcatcatgtcgattatgcgtgtggtggttcaggttgttgcggttgttatacaggtggtggcccgtattcttgcggttgtggctccgatggtggcggctgtggtagggtttgttgcccgtattgttggtgctgtcgtgtcggctgtggcccgtgttattgccactgttgcccgtgttatcgggtggcttgtggctaattttgtgtctggtttggcacgtatgggttcggttattcaggctggctggaatcgtattaggtcgtttacgtctgcgtttatgggcggtttcaagtcgatcatttctgccggtgtggccgcggttgtcgggttttttgcccggcttggtttgtcggttgcctcccatgtgaggtctggttttaacgcagcccgtggcgctgtttcttccgctatgaacgggatacgtagtgtggtgtcttcggtggcgtctgctgttggcgggtttttcagttcgatggcgtctagggttcgtggtgctgcctcgtccgggtttaatggtgcccggagtgcggcatcgtctgctatgcatgctatgggctcggctgtgtctagtggtgttcatagtgtgctagggttttttcggaatctgcctggcaatattaggggcgccttgggtagtatgggctccttgttggtgtctgctggccgtgatgtggtggccggtttgggtaatggtatccggaatgctatgagtggcctgttggatacggtgcgtaacatgggttctcaggttgctaatgctgctaaatcggtgttgggtattcattccccgtctagggtgtttcgtgaccaggttggccgtcaggttgttgccggtttggctgaggggatcaccgggaatgcgggtttggcgttggatgcgatgtcgggtgttgctggtcggcttccggatgcggttgatgcccggtttggtgtgcgatcgtctgtgggctcgtttacgccttacgaccggtatcagcgtgcgaacgataagagtgttgtggtgaatgtgaatgggcctacttatggggatccgaacgagtttgcgaagcggattgagcggcagcagcgtgacgctttgaacgcgttggcttacgtgtgattgggggtgttgtgtatgtttattcctgacccgtctgatcgtgccggtttgactgttacctggtctatggatccgctgtttggtgtggagcgtgtgcttcatttgacggattatacgggtgcgtctcctgtcatgttgttgaatgattcgttgcgcggtttgggtgttcccgaggtggagcatttttctcaaactcatgttggggtgcacggctcggagtggcgcgggtttaatgtgaagcctcgcgaggtgacgctgccggtgttggtgtcgggtgttgacccggatccggtgggcgggtttcgtgacggttttttgaaggcctatgacgagttgtggtctgcttttccttcgggcgaggagggggagttgtcggtgaagactcctgccggtgttgagcgtgtgttgaagtgtcggtttgattcggtggatgacacgtttacggttgatccggtgaatcgtggctatgcgcgttatctgttgcatttgacggcttatgacccgttttggtatggggatgagcaaaagtttcgttttagtaacgcgaagttgcaggattggttgggtggcggccctgtcggcaagaagggtacagcgtttcctgtggtgttgacgcctggtgttggttcgggttgggataacctgtccaataagggtgatgtgcctgcgtggcctgtgattcgtgttgagggcccgttggagtcgtggtctgtgcagattgatggtttgcgtgtgtcttctgattatcctgtcgaggagtatgattggatcactattgatacggatcctcgccggcagtctgctttgttgaacgggtttgaggatgtgatggatcgtttgacagagtgggagtttgcgcctatcccgcctggcggttctaagagtgtgaatattgagatggttggtttgggtgccattgttgtgtcggtgcagtacaggtttttgagggcttggtgaatagttgatggctggtcttgttccgcagataacattgtttacaccggattatcaccgtgtggcgcctatcaatttttttgagtcgttgaaactgtcgttgaagtggaatggtttgtcgacgctggagttggtggtgtcgggggatcattccaggcttgacgggttgacgaagccgggggcgcggctggttgttgattatggtggcggccagattttttctgggcctgtgcgtagggttcatggtgtgggtccttggcgttcttcccatgtgactatcacatgtgaggatgatattcgcctgttgtggcgtatgttgatgtggcctgtgaattatcgtcccggtttggtgggtatggagtggcgtgccgacagggattatgcccactattcgggtgcggcggagtcggttgctaagcaggtgttgcgggataatgcttggcgttttccgcctggtttgtttatgaacgacgatgagcagcgtggccgctatattaaagattttcaggcccggttccacttgtttgccgataagttgttgccggtgttgtcgtgggctcgtatgactgtcacggtgaaccagtttgagaatgcgaagtttgatcagcgtggtttgctgtttgattgtgtgcctgctgtgacgcgtagccatgtgttgactgccgagtctggttcgattgtgtcgtgggagtatgtgcgtgacgccccgaaggctacttcggtggtggttggtggccgcggcgagggcaaggacaggctgttttgcgaggatgttgattcggcggccgaggatgactggtttgatcgtgtcgaggtgtttaaggatgcccgtaacacggattccgagaaggtgcatctcatcgatgaggctgagcaggtgttgtccgagtcgggggccacgtcggggtttaagattgagttggctgagtcggatgtgttgcggtttgggcctggccgcctgatgccgggtgatttgatctatgtggatgtgggttctggtcctattgcggagattgttcggcagattgatgtggagtgtgtatcgcctggtgatggttggacgaaggtgactccggttgcgggggattatgaggataatccgtcggcgttgttggctcgccgtgtggctggtttggctgcgggtgtgcgggatttgcaaaaattctagaaaagattaggggtttgttgtgggtattgtgtgtaaagggtttgatggtgtgttgaccgagtatgattgggctcaaatgtctggtctgatgggtaatatgccttcggttaaggggccggacgattttcgtgtcggcacaacgatccagggtgccacagtgttgtgtgaggttctgccggggcaggcttgggctcacggggtgatgtgcacgtcgaatggtgttgagacggtgacagggcagctgcctggcccgggtgagactcgatacgactatgttgtcctgtctcgggattgggagcagaacacggccaagttggagattgttcctggggggcgtgcggagcgtgcccgggatgtgttgcgtgcggagcctggcgtgtatcatcagcagctactggcgacgttggtggtgtcgtctaacgggttgcagcagcagctggataggcgtgctatagcggctcgtgtggcgtttggcgagtctgctgcgtgtgatcctacccctgtggagggtgaccgtgtgatggttccttcgggggctgtgtgggctaaccataacggtgagtggctgcagttgtctccgcgtattgagacgggttcgaagtcgatcatgtttggcggatcgagtgtatatgcttacacgatccagtttggtcgccagtttagtagtccgcctgtcgtggtggcgtctatgggcaccgcggcggggggtacgcagcagattgatgtgaaagcctacaatattactacgagtaagtttgatttggcgtttattacgaatgatggttcgaagccgaatggtgcgcctgcggtggctaattggattgctgtcggcgtgtgactgcacgggtgttatggcggatggtgtgatgttggggggctgtggtgtcgtggtttactcctgcactggtggcctctatctgtaccgcgttggccacggttttgggttcggttcaggctgtcacatcccggtctaggaagcgtttacgcaggctgtctgcgcaggtggatgcgatggaagagtatacgtggggtgtgcggcgcgaggtgcgaaggtttaacgccgggcttcctgacgatgtggagccgatgcatcttcctgatttgcccgagtttttgaaagatactgttgatggtggaggtgagtagggttgagggagttggaggaggagaagcggcagcgccgcaattttgagaaggcttcactggtgttgttgtttttgtcgcttgtgctattggcggtggttgctgcgggtgctttgcgtttcggatcggtgtcttctgagcgggattcggagcaggctaaagcccagtctaatggttcggctgctaagggtttggctgcccgtgtgaggcaggtgtgtgcttctggcgggcaggagtctgtgcggcttcaccagtctggcttgtgtgtggatgctcagcgtgttgagcggagtgtgcagggtgtgccgggtccggctggtgtgcgtggcccgcaggggccgcaggggccgcaggggccggctggtgttgatggttctgctgggctggttggccctgttggtcctcagggttcccctggtttgaatggtgtgaagggtcctgacggtttgcctggcgcgaatggatcagatggccatgatggtgttccgggccgtgcaggcgtggacggtgtgaatggagttgatggcgctgatggtcgggatggtgttaatggttcggccggtgagcgcggtgatgtgggcccttcaggtcctgccggcccgcaaggtgcacagggtgaacgtggtgagcgcggccccgccggtgcgaacggatccgatggtaaagacggtaaggatgggcgctcggtggtgtccgtgtactgttctgagggccgcctgtttgtgaaatatagtgatggtgtggcttctactatatcgggttcggttgcctgccagaaggtgaaaccgtctcctgtggttaccgtgtcatcccacaaataaaagatagaaaaggagtgacttatgtcgatggtgtttgggggtggtgtgtggtgagatacattcctgcggcgcatcactcggccggttctaatagtccggtgaaccgggttgtgattcatgcgacatgcccggatgtggggtttccgtccgcttcccgtaaagggcgggcggtgtctacagcaaactattttgcttccccatcgtctggtggttcggcgcattacgtgtgtgatattggggagacggtgcagtgcctgtccgagtctacgattggttggcatgccccgccgaatccgcatagtttgggtatagagatttgcgcggatggcggctcgcacgcctcattccgtgttccagggcatgcttacactcgtgagcagtggcttgaccctcgggtgtggcccgcggtagagaaggctgccatcctgtgtagacgtttgtgtgacaagcatggtgttccgaaaaggaaactgtctgtggccgatttgaaggccggtaaacgtggtgtttgcgggcatgtggatgtgacggatgcgtggcatcagtcggatcatgacgatccggggccgtggtttccgtgggacaggtttatggccgtcgtcaacggcggcagtggagatagtggggagttaacggtggctgatgtgaaagccttgcatgatcagattaaacaattgtctgctcagcttactggttcggtgaataagctgcatcatgatgttggtgtggttcaggttcagaatggtgatttgggtaagcgtgttgatgccctgtcgtgggtgaagaatccggtgacggggaagctgtggcgcaccaaggatgccctgtggagtgtctggtattacgtgttggagtgtcgtagccgtattgacaggctggagtctgctgtcaacgatttaaagaagtgatgtgttgtgggtaaacagttttggttgggtttgtttgagcgtgccctgaaaacttttattcaaacgtttgttgctgtgcttggggtgactgcgggtgtgacttatactgcggagtcgtttcgtggtttgccgtgggagtctgccctgattacggccggggttgctgcggtgttgtcggtggctacctcgtttggtaatccgtcgtttgttgccggtaaaccgaaaacgacgcctgttgtggatgctgggcttgttccaccggatgatcctggaatagtggagtctcacatggttgacgaaacggatcctggcatgatagagcctatcgacgatgccgatgctggaggctatgtgccgaggcgtgctgctgagtcggaagttggcacggtagagtctactgttgcataagtgaatatatgtgtgtgccccagcggtgctgccacgatcgtgtggtggttgctgctggggcactatttttgtgtctataggggttttacaggttgtcgtctagggtgtcttcgagtgtctgttgtaggagtgcacactcggcgagggtgtcttcagcctggtcgacaatgttttgttttgctatgcctggatagttgtcgcggtgattgtagatggcttccagaatgttgtctgccatgatttgtagtgttagggcctggttggtgatgcattccagctcgtctagggcggcctggctagcctccggctgccggttgtccggatgttctgcaaggttgcagtcccacaggatttcttggcatgcatccctggtgtctgcgtccacatcgatgtcgtctaggctgacaccgttggcgttgaggctgatgttgtcgaggttgatgggaaccagatattcgctgctgatgctgcaggtgatgtttgcgagttctgtcatgtttcgtggctgctgctgtatgatgcggcgggccgcggttttgagggctgtgactgttcggtgtctgttactgggcatcgtttctattcttcttccccggtgtagctggtggtgttggtgtactgggtgagtgtgatcaggcactggtcggcccactgtttcaccgtctgccgtgtcacacccaatcgttgggctgccaccgaataggtttgatcatacccgtagacttccctgaatgcggcaagccgtgctagccgtttccgctgtttggatggttcacaggcgagggtgtagtcgtcgatggccagttgtagatcgatcatggtgacaatgttgttgccgtggtgttgtggcgcggttggtgggggtggcattcctggctccacggagggtttccatggtccgccgttccagatccattgtgcggcttgaatgatgtcggcggtggtgtaggttcggttcactggtcatcccctgaacatgttgtcgaggttgtctgggttgctggtgtcgaatcgtccgacgcagtggcagtagtcgtacatgagtttaataatgtgttggtggtctcccaaataggtgtttccgctgatgctgtaggtggctgtgccgtctttcgcgatggtgtatttggcggtgatggtttcggggttttcggtgtcggtgatgatggctgtggtggtggtgcctactgtttggagtatggtggtttgggttccgtcgtcgatggtggttttaaccatggtgtgttttttccctttcagttgcttgtttggttgtcggctagatgaatgatgtcgggtaagggtttcggctggtcgaggtgttgtatggttttgttggctagccgtttggctaccctgtaacacattttggtgtagtgtttgttgtctaggttgtggtattgttcccgcaccgcaatatatagtagggagtcttggtacaggtcgtctgcactgattgcggggtagtgtgcggctgttttggtgcatgcccggttgagtgtgcgtagatgatggtctgtggcccacacccacgatgcggtggtggccaggtctgcttttgttggtcgtctgctcatggcatctctttcatcgggctatctggtagttgtttggtgttttgttgttgatagtgtagcacacgagtccggggtttccggtggtgcccgtcttgtgccgataccatgtggattcgccttccatggatgggcattggatgaaggttcgtgtgccttgctctgagatttcgaggtggtgccggtggcctgccatgagaatattagatacggtgccgttgtggaattcctgtccgcgccaccattcgtagtgttggttgttgcgccattggtgtccgtgggcgtggaggatccgtgtgccggctacttcgactgtggtggtcatttcgtcccggctggggaagtggaagtgtaggttggggtattggttggtgagttggtaggcttctgcgatggcgcggcagcagtccacgtcgaaggagtcgtcgtaggtggtgactcctttaccgaagcgcacggcttctccgtggttgccggggatggatgtgacggtgacatcagcgcagtggtcgaacatgtgtatgagttgcatcatggccatgcgggtgagcctgatttgttccgtcaagggtgtttgtgtgcgccaggcgttgttgccgccttgtgacacgtatccttcgatcatgtcgccgaggaaggcgatgtggactcgttgcggtttgcctgcctgttgccagtagtgtttggcggctgccagggagtgtaggtagtcgtcggcgaagtgtgctgtttctcctccggggatgcctttgccgatttggaagtctcctgcccctatgacgaaggctgcggtgctgtagtcggtgcgggtgtcctgttcgggttttgggggtgtccattcggctaatttatcgacgagttcgtctacagggtaggggtttgttgcgggttggtggtcgattattttttgtacggatcggcctgtttctccgttcggtaaggtccattcggagatgcgtgtgcggcgtacggtgccgttggctagattgtcgtcgatggtgtcgatggcgttgtcgtggttggctagctgtgtgagtagccggtctatgttgtctatcaccggttttcctcttcctcgtgtgtggtggtggcttgtttgcggcggtagtctttaataacggtggcggagatggggtatccggcttgggtgagttgttttgctagccatgaggcggggatagacctgtcggcgagcacgtctgcggctttgcggccgtatcgttggatcaacgtttcagttttggttgccatggtgtcctatcggttgtgtggtgggctgccatcctgtgcggcagtcgccgtcatgtcccggtttgcgtgtgcaccacgtgatggttccgtctgtgtggttgagtgttttgccgcacatgacgttttggagatgctctggcagctggtcggtgttgttattgtcttgctcgtcgagcagggttttttggttggtgaaatgctcggacacggtgccgttgtggactgggagtatccatgttttccattgttgttgcatccgggtgttccagtggaattgtttggccgcgttttctgcttgttttaaggttttgtagtagcctacaatgattcgctggtggttgttgtctggctggtgtggccctcgccagtattgtgccgctacagcgtacctgttgttgtctgtgaaggcgtcccagcagtactcgatgatgtgttgcagcacattatcgggaatgtcttgtgcttggttttcgtcgagccactcgtcgacaatgatgttgtgtatggcgcgtttgtctttggtggtgggtttgaacgagatgctcacagtacgggcctgtcgtcttgcatgaaatcattgaaggatgattcgcttgcgcgtctggcttgtgtgatttgctggtcggtccagtcggggtgttgctgtttcagatagtgccagcggcaggcatcatatgtttcgttctgcaagcgggtgagatggttttcggtgatgatttgtttccacattgtccacgagacgtcgagcctgcggagcatgtccatggccggcacattaaacgagtcaaggaagagtatttcgtgggtgtagtagtttttctcgtaggcgtcccatccgcttcggtgtctgttgggctggtttttggggtaggcttcccggcatactttgtgtaaacgtttggccatgtcgtcgggtagtttaatgtcggggttggcgcggatcatggatcgcatcccgtcgtaggtggtgccccaggtgtgcatgatgtgtagtgggctgtctccatcagcccatttttctgcacagatggcgaggcggatgcgcctccgggcggctttgctggtgttgcgccggctggggattgggcacgtgtcgaggggatccatggtgttttagtgtacctttctggtttagtgttgttgacaggttttactgtagcacagtgtctagtgcttgtgtcaaccctgttttgccggcctgaaggtaggtgtctgtgacatccccgacagtgaggggcgcatgggtggcttgggggagtgccgcctggatggtttgtgccatctgttcgcctgccgggtctgggtcggaccagatgtagatgtggtcgtagccttcaaaaaatttggtccaaaaggtttgccacgaggtggctcctggtagtgctacagctggccatccgcattgttcgaggatcatggagtcgaattcgccttcgcaaatgtgcatgtcggtttgcgggttggccatggcggccatgttgtagatggagcctgtgtccccggccggggtcaaatatttggggtggttgtgggttttgcagtcgtgcgggagtgagcagcggaaacgcatttttcgtatttcggctgggccgccccaggtggggtacatgtatgggatggtgatgcactggttgtagttttcgtggcctgggatggggtcattgtcgatgtatccaaggtggtggtagcgggctgtttcttcgctgatgcctcttgccgagaggaggtcgagtatgttttcgaggtgggtttcgtagagggccgaggctttctggattcggcggcgttccgcaatgttgtaggggcgtatgctgtcgtacattcgggttttctttctctagtcgttgttgtagcttgtggagtccgcctccgataccgcatgtgtggcagtaccagacgcccttgtcgaggttgatgctcatggagggctggtggtcgtcgtggaacgggcagaggatgtgttgctcgtttttggacggattgtagcgtatctggtaggtgtcgaggaggcggcaggtgtcagaggtgtgggaggagctcgttgagggttgataccacataggcttcgctccatggcttgttgcgctgtttcatcactacgagtccgatggtggaattgttttgtttgtttcggtgggtttcgtagttgcgtgcctcccggctggcttgtttcacgaattcggcgagatggggctggccagctttcgcttcgatcacataggtgtggttgccggttgtgaggatgaggtcgccttcgtcctctttaccgttgaggtggaggcgttcgatattgtggccggtgtcgcgtagctggtgcaataatcgtgtttcccattcggcgccggccctgcggttgcgtgcctgctgtgtggccatcatagtcctttgtgtgttgtggtcatgttccagggctgtttttcggcgagtggcccgaagaatgtgtattctgggtatgccctgagccgctcatattttgttccgtctgggctggatttgccggtgcgctgtttcaacactgcgatgcgagcctctgccggtatcgatagcccgttgccattatcctcgccaccatacaatgagactccgaggatgagttgtggtttttcggagagtccgtttttgatttccctccgtgccggggggtgttcgatgtcggagccggttttgtcggtggcgtggtgtgtgacaataatggtggagccagtgtcgcggcctaaggctgtgatccattgcatggcttcttgctgtgcctggtagtctgattcgcagtcttggatgtccatcaggttgtcgataacaatgatgggtgggaaagtgttccacatttccatgtaggcttgcagttccatggtgatgtctgtccatgtgatgggtgactggaatgagaaggtgatgtgcgcgccgtggtggatgctgtctcgatagtattctggcccgtagtcgtcgatgttttgttgtatttgggcggtggtgtgttgggtgttgagtgagatgattcgtgtggaggcctcccagggtgtcatgtcccctgatatgtagagggctggctggttgagcatcgcggtgatgaacatggctagcccggatttttggctgccggaccgccccgcgatcatgaccaaatcccctttgtggatgtgcatgtcctggtttcggtagaggggttctagctggggtatgcggggcagttcggcggctgtttgggaggccctctcgaaggatctttggagagagagcatcggagccttaatctatctattggttgggtgtgttttggtggtcagatggagtcgatatcgatatcagcattagcgggggctgtggtgtcgtctagctggccgttatcgcgcttgtctacgtattcggcaaccttatcgtagatggcgtcgtcgaggggtttgagcacgaccgcgttgaacccgtttttggtgcgcacggtggcgagtttgaaggcctgctcttcgccgagatatgcttcgaggtcgcggatcatggagtgtgggcggtcgttgttgccgcgcgctttttcgatgatggcgttggggatggtttctggggtgccgttgttgagatcctggaaggtgtggaagatggtgacatcagcgtagatgcggtctgctgtctgtccgccgtagccttcagtgttgtgctgaacgtcgcggactttgaaggcgatggcggtggcgtcctggtttcgggaggggttgaagaaggtgctgctgctgttgcggtagttggcgagtcccattgttgtttcctttactgttttgttggtttgtgttggctggtattggtttatcgggtgaggctgtttcgtttgctgcggaacgcctcagacacgtcactgttactggtgatgatctttttgtactgtttgagaaggtctgctagctgtgctttgctggtggctttgttgatccggtcgataataatctcgttttcctggttggcgatcttgttgacgtagtctttggcggctttatcgtatcggtcttgaagcaggattgctgcgctagcgatgagggttgcgaggtcccagtctttggatacggtttcgtctttcaatcctcctagcagatcaataatggattgtttgatgtcttctgcggtgtctccgcggatgacggcccatggggcagcatagtctccaccatatttgagtgtgatagttagctttccgctgtctgtggtgtgctcgtcggtcacgtgttttccttttctttcttgtctgtttggggtggctgtacggtggtttctatcgggtatctgtaggcgtttttcccgttgacagcccagcaggcgtccctgacggggcatcctttacagagtgctgtgacgtggggtacgaagatgccttgactgattcctttcattgcttgactgtacatggatgatacatgccggtaggtgttgttgtcaaggtcgtagagttcggttgctgtgccctgctcgactgattgctcgtctcccttggtggtggcgggtgtccaaaacatgcctttcgtcacatggatgccgtgttgttctagcatgtacctgtatgtgtgcagctgcatactgtcggctggtaggcgtcctgttttgaggtccaaaatgaaggtttcacccgtattcgtgtctgtgaatacccggtcgatgtagccgacaatctgggtgccgtcttggagggtggtttctaccgggtattcgatgcctggctggccgtcaataacagcggtgatgtattctgggtggttgcgcctccatgttttccaccggtccacaaaggtgtggccgtagaccatccaccagtcgtagtctttcttgtgtggcccgcccgactcgcacatgtttttgcatattctgccggagggtttgatttctgtgccttcggattcggcgagggctacttgtgtggcgaaaatgtttgtgaaagatgagagtttgtctggcagtgcagggtattcggcgggattgtacaggtgtaggtcgtattgttcggtgatgtggtgtatggcgcttccggcgatggtggcgtaccaggtgtggtgttgggtgtggtagccgtgggataggcgccatttttctccgcattcggcccactgggtgagtgaactgtaggagatgtggcctggatggtggatggttttcggatattgtgctagaggcattacttgtcgcttttattccatgggttgcgggtgtcttggccggcctggtgttgctggtaggcgaggagtgcgaggcagtgccaggcagcatgggccagatggggtagcccggattcataatcgaggttgttgccttgctgccatgatagtaggtgcctgtagagggcgtcgacgctgtggctccacgggtagccgccggtccagttgttgtcgccatatttggtggcgccgtatccggccacagagcctagggcgtgaagggatgctgggtcgatgagggagagtctgcaaagtttcaattcttttcgggcaccagtatcagggtcggtgtacatgctggtgggctcatccatggggtgtgtgctccttacgtgtggggttactggttggggttgtgggctagggcgacggcgagaataatgatggcgagggtttcagcgatgaggatgggtgctgtgatcatttggtgtttcggggattgttggtgagtgtggaggcgcctagcaggatggctagcgcacagacggctgtgatggcgagggctgccttgtggccggtgccggttgcgtacatccatgtgatgatggcgccttggatccatgccagtgcggtgaagaacgtttcgtagctgtgcagctcaatgttattgttgggtgtgttcatgcttgctcctgaagaatggtgttgatggttttataaatgttgtacaggtctgtttcgatagataacagttggttgatttggtggtcgagattaatgtttgggttgagggtgttgatgcgggaggcgatatcggtggctgtgcgtagtgtgccgccggtgtggtgaataatgtgtgccgtgtcggcgagtccggtggtgacagcgtagtgggataggagaggcatgactgggggatgctccttggcgggttactgttgcgggttgatgttgaggtcggtgacgtgcgggtgttcttctgttcctgtgacgaggcagtggacggtgactgggagtttggatgcgccgggctgtttcatggttgcgccgtagacgatgctgaatgtgtctttaccaataattttgtggagttggaggtcgatgtcggggttgccgttccagttgacaccgtgtgcggcggcctgttgttcggctttgcggttgcaggtgtgtgctgccgtgatcatggtgagaccttgtgaggtttcttcaccccttgcttgggcttgctggtgggctttggcctgctcggctcgcagtgactgttctgcggctgcctgccgtgccgctttctcggctttgcgctgctgagcggtttcaggtgtccaggtggtgttggctgtggtggcttggggtgcgggttgtgaggcgagtggcggattgtcgtctggggctggcatgaatgagacggcggcaatgatggcggctgtgattccggcgatggtgtagccgtttttcttgttcatgttttgtgtcccctttccggggtgttgttcgttgctgacatgattaatcatggtgtgggcggtggcctgtgtcaaggctgcgctcaacgattgtgagcgatccttgtatggctaggtgttttatcgggcgcacagggtgagtagatggccaacattgatgcggctcacattccagtagagttgtgtggcttcaccgccggtgagtggcttccactcgttgtggctgaacacggtgccatcggatgctatgaatatgtcggggcgtagcttgtggagttcaatctctacgctctgccggtaggcttcggcgaggccctcaaaatccatgtggttgcaggagaggttttcgaggcgtgtcaggtcgaagggtgtggggcagtcgtagctggcgggggtgtagagctgggtgaagtggttggcgatcttctgcatcatgattccttttctggtgatggtgtgttgatggttttatcgtgtggattcggcgatgatggcatccacatcgattgtgtcgatcatgtcgtggaggtcttcggcctcatccacggtgagtggctgccaatcctggggtccgtatatggcaccgtcgagagtgatggtccacaggggccggatgagtcgtacggcttcttcgactttggcacggtataggcggcagatgatagacgtgtgggtgttacctatgtcacatcctgccaggtgtgcggggtggagtgggttgatttctgtctgcccgtagaggctggtgaaggatggtgtgatgagtgtgccatccatgggtgatgttcctttctggactgtctgggttggttgttgtggtttctagagtgtgtaggttgcaaccgggagtcaaggctgcactcattcggattgagcgtttcatggagggtgtgtcaggtgtgacagatgtcactgaagcctttattgcctctctcagcgcctgaaatcttctgggggtaggattatatagggttgaccctggtagtcgattctagaccccatacagggcgtctcaggggtatgtctgggtgatggcgggtatggcaggtgatctagcgggtcgagataggcctgcatcgcaaaggtcgaggttccagatctgggcatggaatctacaccctcatactgtgtgagatgtatcacatcctcctggcttggtgtgtactctcgagactactctgccgatctgacatggagggtgtagcccagaaataccatttaaagccttcacacggcgcctaggagcgccttacagggtgggggctatgtatttatacccccagcacattctgatcgattctagacgcccccaaaagcctgatacacgatcaaccatttcggcatagatcatcagcccctatcctgcttagctaagcctcaactatgtggacagtgttggatgctaagagggaagaaggacacggtaaaaagaagagggggagcatcagccttcacacctgaggtacttaagttcacattaaagtcttagcactcagtacttagcaccgagcccctcaagggctcggcatcagcccaaacaggctcagccgatcaggcacagcactgaaaagggtacacgccatcagggaaggcttgagagtacgaggagcctcagcgacgcgtactcgaaagcctgagggaacacccatcagcactgatgggcctagcgtgttcggaaaggacacaggagtgaagtgtgacagctgtccgggagtgaaacctgttctggctaggggtttcagccttaaccaccctcaaaggttacaagactctaagaaaatttaagaaaactcttaggaagaaagttgtgttcatatccccctaaaaacacccaaaatagccctcaaacccgcctatagagccaaacagtcaagtttgactcgtctagacggcgtatgctaggctggacaggtagccagctggacgcaaggccagaaagtgctgacgcacttcccgacctcgcttaccatcagtctaccaaacactttaaagcttcaaggctaagcgctaagcctttaagaccttaacgcttagcaccgagcccctcaagggctcggcatcagccttaaagttttaaacactttaagtaactataaagctttaaaccttaacacctaagttaagtataaaaccttaaaggcttagcacttaaggatataaactttacatcagtgtttaagactttaaaacttaaagtaactataagactttaaagaccttaagtacttaaagttaatcatcagtcttaaactttaatattataacctataagtcttaaagcttataggtataataatataatataagttataaaagttttagaagagctaaagggttaacttctttacttctcttctctctttggttctttctctcttctcttcttttcttcatcaggggagaagaggaacctttaccgtcaacgctgatggacttttcgccgtgtgactcgtgtaccaccggtcgcacgctcccggttgcacactcaccacacttactctacccgtgtccctttcaggcttggcgtgttcggctgaaggcgtacggcgtgtcacgctaaaacccttaacactaggtaagacttaaagtgtatattatatgtagaagactttaaaaaacctataaggtattcctgcttagcccgtgtcctactctgctaggcgccaagcgctaagccttgaaacgcgaacacccatccacccccatttttcttccgtgtccttcttcttttgacaccgctggggggcgatgtgatctttctcacatgccaggggatgtgagggaaaacaaacaccccggcacaaacagaacaccccctcaaacgaacaaaacagccctcagaatcgatgagcagggcaagggcaaggtattcatacccccaacggttcccaggctgttacaggagcaatgagagcccatagaggcgtggtagacgataggggagcgttatggcacacaccaaccgcaccgcatccgcctcacaccgacgctggcgggctcgactcataacccaggccagacagcaaggccaaaccgaatgcccactctgcggagcaaccatcacctgggacacacaccagctaccaaccagccccgaagccgaccacatcacacccgtcagccggggaggactcaacaccctcgacaatgggcaaatcatctgcagaacatgcaacagaagcaaaggtaatcgcagcgaaccaaacatcacattccaacaacaaaccacaaaaacattgattccatggtgaaaaacccgccaacccccaccggggacaccccctgcacacccgtgcaagacc

SEQ ID NO: 43 - DNA, 29453 bp, Unknown
  source: /note="Description of Unknown: Bacteriophage of P. acnes"
agtgaaatacctcccttttgtggatttatctgtttgtcgactttttgtgttggtggtgagtgttgtgcagcctgagcttcctgggtctcgtgattggtgtggggagacgcttcgctggtggcgtgtgtggggtgaggatagtcgcgcatcgtacgtgtcggatgaggagtggctgtttctcatggatgctgcggtgattcatgattgtgtgtggcgtgagggccgggctgaccttgtggcttcgcttcgtgctcatgtgaaggcttttatgggcatgttggatcgttattcggttgatgtggcgtctggtggccgtggtgggggttctgcggtggcgatgattgaccggtatcggaagcgcaagggggcctgattaggtgtctggtgttgttgggtctcaggtgcctcgtcaccgtgtggctgcggcgtattcggtgactgccggcggggatgctggggaattgggtcgtgcgtatgggttgatgcctgatccgtggcagcagcaggtgttggatgattggcttgctgtcggtggtaatggcaggcttgcttctggtgtgtgtggggtgtttgttccgcggcagaatggcaagaatgctattttggagattgtggagttgtttaaggcgactattcagggtcgccgtattttgcatacggctcacgagttgaagtcggctcgtaaggcgtttatgcgtttgaggtcgttttttgagaatgagcggcagtttcctgacttgtatcgtatggtgaagtcgattcgtgcgacgaatggtcaggaggctattgtgttgcatcatccggattgtgccacgtttgagcgtaagtgtggctgtccgggttggggttcggttgagtttgtggcccgttctcgtggttctgctcgcgggtttacggttgatgatttggtgtgtgatgaggctcaggagttgtcggatgagcagttggaggctttgcttcctaccgtgagcgctgcaccgtctggtgatcctcagcagattttccttggtaccccgccggggcctttggctgacggtagcgtggtgttgcgtcttcgcgggcaggctttgtcgggtggtaaaaggattgcgtggacggagttttcgattcctgacgagacggttccggatgatctatcgaggtcgtggcggaagttggctggggatacgaatcctgcgctgggtcgccgcctgaatttcgggacggtgagcgatgagcatgagtcgatgtcggctgccgggtttgctcgggagaggcttggctggtgggatcgtggccagtcggctacgtctgtgataccggccgataagtgggctcagtctgctgtggatgaggcgagtctggttggcgggaaagtgtttggtatctctttttcgcgatcaggcaatagggttgctttggctggtgccggcaggactgatgctggtgttcatgttgaggttattgatggcctgtcggggacgattgtggatggtgtaggccagctggctgactggttggcgttgcgttggggtgacacggaaaagatcatggttgccggttcgggtgctgtgttgttgcagaaggctttgactgatcgtggtgttccgggtcggggtgttgtggttgccgatactggggtgtatgtggaggcgtgtcaagcctttctggaaggcgtaaggtctgggagtgtttctcatcctcgtgctgattctcgccgtgacatgttggatattgctgtaaggtcggcggttcagaaacataaaggctctgcgtggggttggggttccacatttaaggacggttctgaggttcctttggaggctgtgtcgctggcgtattttggtgcgaaaacagttaaagcgaagcggcgtgagcgtagtggtaggaagcgggtgtctgtggtatgaactcggatgagttggctctgattgagggcatgtttgatcgtattaagagtttgtcttcgtggcattgtcgcattgagggctactatgagggttctagccgggtgcgtgatttgggggtagctattcccccggagttgcagcgtgtgcagactgtggtgtcgtggcctgggattgcggtggatgctttggaggagcgtctggattggctgggctggactaatggtgacggctacggcctggatggtgtgtatgctgcgaatcggcttgctacggcgtcgtgtgatgtgcatttggatgcgctgatttttggtttgtcgtttgtggctatcattcctcatggtgatggttcggtgtcggttcgtccgcagtcaccaaagaattgtactggccggttttctgccgatgggtctcgtctggatgctggccttgtggtgcagcagacgtgtgatcctgaggttgttgaggcggagttgttgcttcctgatgtgattgttcaggttgagcggcggggttcgcgtgaatgggttgaggtggatcgtataccgaatgtgttgggtgctgttccgcttgtgcctattgtgaatcgtcgccgtacttctaggattgatggccgttcggagattacgaggtctattagggcttacacggatgaggctgtgcgcacactgttggggcagtctgtgaatcgtgatttttatgcgtatcctcagcgttgggtgactggcgtgagcgcggatgagttttcgcagcctggctgggtcctgtcgatggcttctgtgtgggctgtcgataaggatgatgatggggacactccgaatgtggggtcgtttcctgtcaattcgcctacaccgtattcggatcagatgagactgttggcgcagttgacggctggtgaggcggctgttccggaacgctatttcgggtttatcacgtctaacccgcctagtggggaggctttggcggccgaggaatctcggcttgtgaagcgtgctgagcggcgccaaacgtcgtttggtcagggctggctgtcggttggtttcctggctgccaagtcgcttgattcttccgttaacgaagctgatttttttggtgatgttggtttgcgttggcgtgatgcatcaacacctactcgggcggctacagcggatgctgtgacgaagctggttggtgccggtattttgcctgctgattctcgcacggtgttggagatgctggggcttgatgatgtgcaggttgaggctgtgatgcggcatcgcgccgaatctgcggatccgttggctgcgcttgctggggctatttcccgtcaaacgaacgaggtttgatggatggcttcgggtgctatgtcgaggctggctgcgactgagtatcagcgtgaggcggtcaggtttgctgggaagtatgcgggctattattctgagcttggccgtttgtggcgtgccggcaggatgagtgacacacagtatgttcgtttgtgtgtggagttggagcgtgccggccatgatggttcggcgtcgttggccgccaggtttgtgtcggattttcggaagcttaacggtgtcgatcctggtttgattgtgtatgacgagtttgatgctgccgcggctttggctaggtcgttttcgactatgaagattatgaatagtgacccggatcgggcgaatgatacgattgatgcgatggcggcgggttttgatcgggctgtcatgaatgctggtcgtgacacggttgagtggtctgcgggtgcgcagggtaggtcgtggcgtcgtgtcacggatggggatccgtgtgctttttgtgccatgttggctacgaggtcggattatacgactaaggaaagggcgctcactactggtcatacgcggcgtcataagcgtggtggtaagcgtccgtttggttcgaagtatcatgatcattgtgggtgtacggtggttgaggttgttggcccttgggaaccgaatagggctgatgccgagtatcagaggacgtatgagaaggctcgcgagtgggttgatgatcatgggttgcagcagtcgcctggcaatattttgaaggctatgcgtactgttggtggcatgagataatttgatgtggtttccggttgtgcgccgccggttatcggtgcacagggttgtctcccgcacgggggtcaacaatgttgtgttgttttccgcaaggagtgtagggttaggctatggccgatcagagtgttgaggaacagaatgttgacaatgatgttgtggagtccggaaagggtgacggcattgttgacacggtgaagggcgatcaaggcaaacaggttgaagatcagtcgaagaatgaaggcgagggtaaatcgccggggactgattggaaggctgaggctcgtaaatgggagtctcgtgcgaaaagtaatttttccgagctggagaagcttcgtacatcgagtgacgattctggatctactattgatgagcttcgccgcaagaatgaggaactcgaagacaggatcaacgggtttgttcttgagggtgtgaagcgtgatgtggctgccgagtgtggcctttcgggtgatgctgtcgcttttctgcacggcgacgatcgtgaagcgctggtggagtctgctaaggctttgaagggtttgatcgaccatagtagtggtggcgcgggtgtgcgccgtcttgcggggagtgcccccgttgatgatgttaaacgacgtgagggtgtcgcgtttgtggatgctcttgtcaataattctaggagatgatttgtgatggctgacgattttctttctgcagggaagcttgagcttcctggttctatgattggtgcggttcgtgaccgtgctatcgattctggtgttttggcgaagctgtcgccggagcagccgactatttttggccctgtgaagggtgccgtgtttagtggtgttcctcgcgctaagattgttggtgagggtgaggttaagccttccgcgtctgttgatgtttcggcgtttactgcgcagcctatcaaggttgtgactcagcagcgtgtttcggacgagtttatgtgggctgatgctgattaccgtctgggtgttttgcaggatctgatttccccggctcttggtgcttcgattggtcgcgctgttgatctgattgctttccatggtattgatccggctacgggtaagcctgctgcggctgtgaagacttcgctggataagacgaagcatgttgttgatgccacggattctgccacgactgatctggtcaaggcggtcggcctgattgctggtgatggtttgcaggttcctaacggtgtcgccctggatccggcgttctcgtttgctctgtcgactgaggtgtatccgaaggggtctccgcttgccggtcagccgatgtatcctgccgccgggttcgctggtttggataattggcgcggcctgaatgttggtgcttcttcgactgtttcgggtgccccggagatgtcgcctgcctctggtgtgaaggctattgttggtgatttctctcgtgtccattgggggttccagcgtaacttcccgatcgagctgatcgagtatggtgacccggatcagactggccgcgaccttaagggccacaatgaggttatggttcgcgccgaggctgtcctgtatgtggctatcgagtcgcttgactcgtttgctgttgtgaaggagaaggcttccccgaagcctaatccgccggccgagaactgatttatttgttgcgataatgttcatgctgtgtgcagggggtggtgttgatgggtatcattttgaggcctgaggatattgagcctttcgccgatattcctaaagataagcttgaggcgatgattgccgatgtggaggctgttgctgtcagtgtcgccccctgtatcgctaaaccggatttcaaatacaaggatgctgctaaggctatcctacgtagggctttgctgcgctggaatgatactggtgtttctgggcaggttcagtatgagtctgcgggcccgtttgctcagactacacggtctagtactcccacgaacttgttgtggccttccgagattgccgcgttgaagaagctgtgtgagggtgatggtggggctggtaaagcgttcactatcacaccgaccatgaggagtagtgtgaatcattctgaggtgtgttccacggtgtggggtgagggttgctcgtgcgggtcgaatattaacggctacgctggccctttgtgggagatatgatatgaccagttttccttacggtgaaacggttgtgatgcttcagccgactgttcgtgtcgatgatttgggcgacaaggttgaggattggggtcatcctgtagaaaccgtgtaccataacgtggctatctatgcttccgtttcgcaggaggatgaggccgcggggcgtgattctgattatgagcattggtcgatgcttttcaagcagcctgttgtgggcgctgattatcgttgtaggtggcgtattcggggtgtggtgtgggaggctgacgggtctcctattgtgtggcatcacccaatgtctggctgggatgctggtacgcaggttaatgtgaagcgtaagaagggctgatggttgtggcacgtgatgtgaatgtgaagcttaatcttcctggtatccgtgaggtgttgaagtcttctggggtgcagggcatgttggcggagcgtggcgagcgtgtcaagcatgcggcctctgctaatgttggcggtaatgcttttgatagggcccagtatcgtgccgggttgtcgtcggaggtgcaggttcaccgtgttgaggctgtcgctaggattggcaccacctataagggtggtaagcgtattgaggcgaagcatggcacgttggctaggtcgattggggctgcgtcgtgatcgtttacggtgatccgcgaatatgggcgaaacgcgtgctcaaggatgatggctggctgtccgatataccgtgtacaggtactgtcccggatgatttcacgggtgacttgatttggttggcgttggatggtggcccgcagttgcatgttcgtgagcgtgtttttttgcgggtgaatgtgttttctgatatgccggatcgtgctatgtctttggcgcgtcgtgttgaggctgtgctggctgatggtgttgatggtgatccggtggtgttttgtaggcgttctactggtcctgatttgttggttgatggtgcacgttttgatgtgtattcgctgtttgagctggtgtgccgtcctgtcgaatccgagtaaacgtatttgttttctatattttgtttttgtttgattatttttgggggttgtgatggctgctacacgtaaagcgtctaatgttcgctctgctgttacgggtgacgtctatattggtaaagctcatgccggtgacactattgatggtgtgaagacggttcctgacggtcttaccgctttagggtatctgtctgatgacgggtttaagattaagccggagcgtaaaacggatgatttgaaggcttggcagaatgcggatgttgttcgcactgtggctacggagtcgtctatcgagatttctttccagctgatcgagtctaagaaggaggttatcgaactgttttggcagtcgaaggttactgccggagccgattcgggttcgttcgatatttctcctggtgccacgacgggtgttcatgccctgttgatggatattattgatggcgatcaggttattcgctactatttccctgaggttgagttgattgatcgtgacgagattaagggtaagaatggcgaggtgtacgggtatggtgtgacgttgaaggcgtatcctgcccagattaataagaatggtgatgcggtgtcgggtcgggggtggatgacggctttaaaagctgatactcctccgactcctcctccggccccgaagcctccgaagcctgagccggatccgaatccgccgtctaataactgatacacatagtttgagggattgttgatagatgagtgacacaggttacacgttgaagattggtgaccgtagctgggtgttggcggatgcggaggaaacggcgcaggctgttcctgcccgcgttttccgtcgtgccgccaggattgcccagtcgggggagtctgcggatttcgcccaggttgaggtgatgttttctatgttggaggctgccgccccagaggatgctgtggaggccttggaggggcttcctatggttcgtgtggccgagattttccgccagtggatggaatataagcctgaaggtaagggtgcctcgctgggggaatagtttggctccacggcctgattgatgattatcgtggggccatcgaatacgatttccgcactaaatttggtgtttctgtttatagtgttggtggcccgcagatgtgttggggtgaggctgtccggctggctggcgtgttgtgtaccgatacgtctagccagttggcggcccacctgaatggttggcagcgcccgtttgagtggtgtgagtgggctgtgctggacatgttggatcattacaggtctgctaatagtgaggggcagccggagcctgtggcgaggcctacggatgagcgtagggcccggtttacgtctgggcaggtggacgatattttggcgcgtgttcgtgccggcggcggggtgtctcgcgagattaatattatggggtgaatagtgtatgtctggtgagattgcttccgcatatgtgtcgttgtatacgaagatgcctggccttaaaagtgatgttggtaaacagctttctggggttatgcctgctgagggtcagcgttcgggtagtctttttgctaagggcatgaagttggctcttggtggcgccgcaatggtgggtgctatcaatgttgctaagaagggcctcaagtcgatttatgatgtgactattggtggcggtatagctagggcgatggctatcgatgaggctcaggctaaactgactggtttgggtcatacgtcttctgacacgtcttcgattatgaattcggctattgaggctgtgactggtacgtcgtatgcgttgggtgatgcggcttctactgctgccgcgttgtctgcttcgggtgtgcagtctggcgggcagatgacggatgtgttgaagactatcgccgatgtgtcttatatttcgggtaagtcgtttcaggatacgggcgctatttttacgtctgtgatggctcgcggtaagttgcagggcgatgacatgttgcagcttacgatggcgggtgttcctgtgctgtctttgcttgccaggcagacgggtaaaacctcggctgaggtgtcgcagatggtgtcgaaggggcagattgattttaacacgtttgcggctgcgatgaagcttggcatgggtggtgctgcgcaggcgtctggtaagacgtttgagggcgctatgaagaatgttaagggcgccttgggctatcttggtgctacggctatggccccgtttcttaacgggttgaggcagatttttgttgcgttgaatccggttattaagtcggtcacggattcggtgaagccgatgtttgctgccgtcgatgctggtattcagcgtatgatgccgtctattttggcgtggattaatcgtatgccgggcatgattacgagaatgaatgcacagatgcgcgccaaggtggagcagctgaagagcgtttttgcgagaatgcatttgcctgtcccgaaggtgaatttgggtgccatgtttgcgggtggcacagcagtgtttggtgttgtggctgcgggtgtggggaagcttgttgcagggtttgccccgttggcggtgtcgttgaagaatcttctgccgtcgtttggtgctttgaagggtgccgctggcgggcttggcggcgtgtttcgcgccctgggcggccctgtcggtattgtgatcggcttgtttgctgccatgtttgcgacgaacgcccagttccgtgccgcggtgatgcagcttgtggctgtggtgggccaggctttggggcagattatggccgctattcagcccttgtttggtttagtggccggtgttgtggcacagttggcgccagtgttcggccagattatcggtatggttgccggtttggctgcccagattgtgcctttgattagtatgcttgtcgcccggctggttcctgtgattacgcagattattggtgcggtgactcaggttgctgcaatgttgttgccggcgttgatgccggtgcttcaggcggttgtggctgtgatacggcaggttgttggtgttgtgatgcagcttgtgcctgtgttgatgcctgtgattcaacagattttgggtgctgtgatgtctgtgttgccgccgattattggtttgatacggtcgctgataccggtcatcatgtctgttatgcgcgtagtggtgcaggttgtttcggttgtgttgcaggtggttgcccgtattattccggttgtgatgccgattgttacggctgtgatcgggtttgttgcacgtattttgggtgctattgtgtcggctgccgccaggattattggggctgttgcccgtgttgtcggatgggttgtgggccatttcgtgtcgggtttggcgcgtatgggttcggttattcaggctggctggaatcatattagggcttttacgtctgcgtttattaacggtttcaagtcgatcatttctggcggcgtgaacgcggttgtcgggttttttacgcggcttggtttgtcggttgcctcccatgtgaggtctggttttaacgcggcacgtggtgctgtttcttctgcgatgaatgctatccgtagtgtggtgtcttcggtggcgtctgctgttggcgggtttttcgggtcgatggcgtctagggttcggaatggtgctgtgcgcgggtttaacggggcacggagtgcggcctcttctgctatgcatgctatggggtctgccgtgtctaacggtgtgcatagtgtactgggttttttccggaatctgcctggcaatattcggcatgctctcggcaatatggggtccctgttggtgtctgctggccgtgacgtggtgtctggtttgggtaatggtattcggaatgctttgagtggcctgctggatactgtgcgtaatatgggttcccaggtggctaacgctgcgaagtctgtgttgggtattcattccccgtcgagggtgtttcgtgatcaggttggccgtcaggttgttgccggtttggctgaggggatcaccgggaatgctggtttggcgttggatgcgatgtcgggtgttgcttcgcagcttccggatgctgtggatgcccggtttggtgtgcgatcgtctgtgggctcgtttaccccgtacgaccggtatcggcgtgctcagggtgagagtgttgtggtgaatgtgaatggcccgacgtatggtgatcctgccgagtttgcgaagcggattgagcgtcagcagcgtgacgctttgaacgcgttggcttatatgtgagtaaaggggtatgcatgtttattcctgacccgtctgatcgttctggtttgactgtgacatggtctatggatccgcggtttggtgatgagcgtgtgcttcatttgacggattatacggggtcgtctccggtgatgttgttgaatgattcgttgcgcggtttgggtgttcctgaggttgagcatttttctcaaactcatgttggggtgcacgggtcggagtggcgcgggtttaatgtgaagcctcgcgaggtgacgttgccggtgttggtgtcgggtgttgacccggatccggtgggcgggtttcgtgacggttttttgaaagcctatgacgagttgtggtctgcgtttcctcctggcgaggagggggagctgtctgtgaagactcctgccggtgtagagcgtgtgttgaagtgccggtttgattcggtggatgacacgtttacggttgatccggttaatcgtggctatgcgcgttatgtgcttcatttgacggcctatgacccgttttggtatggggatgagcaaaagtttcgtttcagtaacgcaaagttgcaggattggttgggtggcggccctgtcggcaaaaacgggactgcttttccggtggtgttgacgcctggtgttggttcgggttgggataacctgtcgaataagggtgatgtgcctgcgtggcctgtgattcgcgttgaggggccgttggattcgtggtcggtgcagattgatggtttgcgtgtgtcttcggactatcctgtcgaggagtttgattggatcactattgatacggatcctcgtaagcagtctgcgttgttgaacgggtttgaggatgtgatggatcgcctggatgagtgggagtttgcgccgattccgcctggcggttctaagagtgtgaatattgagatggttggtttgggtgccattgttgtgtcggtgcagtacaggtttttgagggcgtggtgaattgttgtggctggtcttgtcccgcagataacattgtttacgccagactatcatcgtgtggcgcctatcaatttttttgagtcgctaaaattgtcgttgaagtggaatggtttgtcgacgctggagttggtggtgtctggtgatcattcgaggcttgacgggttgacgaggccgggtgcacgcctggttgttgattatggtggtggccagattttttctgggcctgtgcgtaaagtgcacggggttgggcctcggcggtcttcccgtgtgactatcacttgtgaggatgatattcgcctgttgtggcgtatgttgatgtggcctgttaattatcgccccggtatggtgggttctgagtggcgtgcagaccgggattatgcccactattctggtgcagccgagtctattgctaagcaggtgttgggggataatgcttggcgttttccgcctggtttgttcatgatagaggatgagaagcgtggccgctatattaaggattttcaggtgcggtttcacgtgtttgcggacaagttgttgcctgtcctgtcgtgggctcggatgactgtttcggtgaaccagtttgagaatgcgaagacggatcagcgggggctggtgtttgattgtgttcctgctgtgacgcgtagccatgtgttgacgtccgagtcgggttcgattgtgtcgtgggagtatgtgagggatgcccccaaggctacgtcggtggttgttggtggccgcggcgagggtcgggatcggctgttttgtgaggatgttgattcgatggccgagggggactggtttgatcgtgtcgaggtgtttaaggatgcccgtaacactgattcggataaggtgtctctttacgatgaggcggagcaggtgttgtcggaatcacaggccacgtctggttttaagatcgagttggccgagtcggatgtgttgcgttttgggcccggcaatctgatgcctggggatttgatttatgttgatgtgggttcggggcctattgcggagattgttcggcagattgatgtggagtgtgattcgcctggtgacggctggacgaaggtgacaccggttgcgggggattatgaggataatccgtcggcgttgctagcgcggcgtgttgccggtttggctgccggtgtgcgggatttgcaaaagttttaaaaaagctcaacggattggggtttgttgtgggtattgtgtgcaagggttttgatggtgtgttgaccgagtatgattgggctcaaatgtctggtctgatgggtaatatgccgtcggtgaaaggtccggacgattttcgtgtcggcacgacgattcagggtgccacagtgttgtgtgaggttttgccggggcaagcgtgggctcacggggtgatgtgtacttcgaatagtgttgagacggtgacgggccagctgccgggtcctggcgagacgagatacgactatgttgttctgtcgcgggattgggagcagaatacggcccggttggagattgttcctggggggcgtgcggagcgtgcccgtgacgtgttgcgtgccgagcctggcgtgtaccatcagcaactgttggctaccctggtgttgtcgtctaacgggttgcagcagcagctggataggcgtgccgtggcggctagggtggcgtttggggagtctgctgcgtgtgaccctacccctgtggagggtgacctggtgatggttccttcgggggctgtgtgggctaaccatgctggcgagtggaggctgttgtctccgcgtatcgagacgggttcgaagtcgatcatgtttggtggatctaatgtgtatgcttacacgatcccgtttgatcgccagtttactagtccgcctgttgtggtggcgtctatggggaccgcggctgggggtacgacacagattgatgtgaaagcctacaatattactagtaaggattttggtttggcgtttatcacgaatgacgggtctaaaccgaatggtgtgcccgcggtggctaactggatagctgtgggcgtgtgacggtacaggcgttgtggtggctggtgtgatgttggggggctgccgtgtcgtggatgactcctgcattggtggcttctatttgtaccgcgttggccacggttttgggttctgttcaggctatcacatcccggtctagaaagcgtttgcgaaggttgtctgcgcaggtggatgctttggaagagtatacgtggggtgtgcggcgtgaggttcgccggtttaacgccaggcttcctgacggggttgatccgcttgtgttgcctgagccgcctggtttcctatcggatgatgttgggggtgagtgatgagggagttggaggaggagaagcggcagcgtcgctcgtttgagagggcttccctgctgttgttgtttttgtcgcttgtgctgttgattgtggttgctgggggtgctttgcgtttcggggctgtatcctctgaacgggattctgagcaggcgagggcccagtcgaatggtacagcggccaggggtttagccagccgtgtgcggcaggtgtgtgcccatggtgggatggagtcggtacggcttcaccggtctggtttgtgtgtggatgctgtgcgtacggagcggagtgttcagggtgtgccgggcccggctggtgagcgcggcccgcaaggccctgcaggtgctgatgggcgtgacggtgttaatggttcgtctgggctggttggccctgttggtccgcagggttctcccggcttgaatggcgtgaaaggtcctgacgggttgcctggtgcaaatggatcggatggccgtgatggtgttccgggccgtgcaggtgttgacggcgctgatggtcgggatggttcggctggtgagcgcggtgatgtgggtccttcaggtcctgccggcccgcaaggtgcacagggggaacggggtgagcgtggccccgtcggtgcgaacggatccgatggtaaagatggtaaggatgggcgctcggtggtgtctgtgtactgttctgatggtctcctggttgtgaaatatagtgacggtgtggcttctacaatatcgggctcggtggcctgccagggtgtgaaaccgtcgcctatggtgactatatcatcccacaaatagaaaggagtggctgtgatggtagtgtttggtggtggtgtgtggtgaggtttatcccagcagcgcaccattctgccggttcgaatagtccggtgaatagggttgtgattcatgcgacgtgcccggatgtggggtttccgtccgcctcacgtagggggagggctgtttctacggcaaactattttgcttccccatcgtctgggggttctgcccattatgtgtgcgatattagtgagacggtgcaatgtctgtctgagtctacgattggttggcatgccccgcctaaccctcatagtttgggtatagagatttgcgcggatggtggctcgcacgcctcgttcagggtgccggggcatgcttacactcgtgagcagtggcttgaccctcgcgtgtggcccgcggtggagcgtgccgcgatcctgtgtagacgtttgtgtgacaaatataatgttccgaaaaggaagcttagtgcagccgatttgaaggctggcaggcggggtgtttgcggccacgtggatgttacggatgcgtggcatcagtcggatcatgacgatcctgggccgtggtttccgtgggacaaatttatggccgtagtctgcggcggtagtggtagtgaggagttaactgtggctgatgtgaaagccttgcatgatcagattaaacaattgtctgcccagcttactggttcggtgaataagctgcaccatgatgttggtgtggtacaggtacagaatggtgatttgggtaaacgtgttgatgccttgtcgtgggtgaagaatccggtgacggggaagttgtggcgcacgaaggatgctttgtggagtgtctggtattacgtgttggagtgtcgcagccgcattgacaggcttgagtctactgttaacggtttgaaaaagtgatggtggtttgttgtgggtaaacagttttggttaggtttactggagcgggccctgaaaacttttattcaaacgtttgttgccgtgctcggtgttactgcgggtgtcacgtatactgcggagtcgtttcgcggtttgccgtgggagtcggcgttgatcacagccacggttgctgcggtgttgtcggttgctacttcgtttggtaatccgacgtttgtggctggtaagccgaagactacggttgtggataccgggcttgttccacccgatgataccggtttgatagaaccgcatgcggtggatgtgtcggatcctggcatgattgagccgatggatgatgcggatgttgccggctatgtgccgaagcgggctgccgagtcggaggttggcacagtagagtctactgttgcataattgaatatgtgtgtgccccagcggtgctgccacgattgtgtggtggttgccgctggggcacactttttgtttatgcgatatggctatgattcgttgctgtcgatggtgtcttcgagcatctgatacaggtggaggcaggtgcagatggtttcgctggcctggtcgagaacgtttcggccgataacgtttttgtggttgtcgcggtggcggatgatagcccacatgatctcgtcggctgccgcctgtaatagttttgcctggtatgcgattccggcgagccagtctagtgcttcctggcttgcctgtgtgtcgtctggaataccacgggtgttgctgttgcttgggtgtccttcactgtcgcatagccacaggatttcgctgcactcgtctagcgtgtcctggtcgatagcgagatcgtcgaggctgacattgttgacggtaaggttcacgttgtcgagggagatgggtacaccgtactggttttcgacactgtcaacaatgttttgtagttgttgcatgttggtgggctgttgttggatgatacggtgtaccgctgctttgagggcagtgtaggggatattgtgtgtgttgttcatggttttatttcatccctgtgctgtcgtcgttatcgtctggatagtatctactgtttgcgtaccctgttagggtgatcaatgtttggtctgcccactgtttcacggtttgccgggttacccctaatcgttgggctgctaccgaataggtttgatcatacccgtatacttcccggaatgctgccaaccgtgctaggtgttttcgctgtttggatggctggcaggtgagggtgtagtcgtcgatggccagctggaggtcgatcatggagacgatgttgttgccgtgatgctggggggcggttggtgggggtggcataccgggttctactgatggtttccatgggccgccgttccagatccattgggcggcttggataatatctgcggtggtgtaagtccggttcactggtcaccccctgaacaggttgtcgaggttgtctgggttactggtgttggtggtgtcgaatcgtcccacacagtggcagtagtcgtacatgagtttgataatgtgttggtggtcgccgaggtaggtgttgccactaatactgtaggtggctgtgccgtctttgccgataatgtatttggcggtgatggtttctggtgtttcggtgttggtgatgattgctgttgtggtggtgcctacggtttgtagcctggtggtttgggttccgtcgtcgagggtggtggtaaccataattggggttttccttaaatgcttgtctggttgtcggctagatgaataatatcggataaaggtttcggctggtctaggtgctgtaccgctttgttggctaaacgtttggctaccctgtaacacattttggtatagtgtttgttgtctaggttgtggtattgttcccgcaccgcaatatatagtagggagtcttggtacaggtcgtctgcactgattgcggggtagtgggtggctactttgatgcatgaccggttgagtgtgcgaagatgatggtcggtggtccatccccacgatgcggtggtggcccggtctgcttttgttggtcgtctactcatggcactatttcatctcgctatctggtagttgtttggtgttttatggttgatagtgtagcacacgagtccggggttgccggtggtgcccgtcttgtgccggtaccatgtggattcgccttccatggatgggcattggatgaaggtgcgttgtccttgctcggagatttctaggtggtgtcggtgcccggccatgaggatgtgggatgtggttccgttgtggaattcttgtccgcgccaccaatcatagtgtttgccggtgcgccattggtgtccgtgggcgtgcaggatttgtgtgcctgccacattgacggtggtggtcatttcgtctcggctggggaagtggaagtgtaggttggggtattggttgttgagttggtaggcttcggcgatggcgcggcagcagtccacgtcgaaggagtcgtcgtaggtggtgacgcctttgccgaagcgcacggcttcaccgtggttgccggggatggatgtgaccgttaggttggcgcagtggtcgaattggtggatgagttgcatcatggccatgcgggtgagccggatttgttcggtgaggggtgtttgtgtgcgccaggcgttgttgcctccttgtgacacgtatccttcgatcatgtcgccgaggaatgcgatgtggactcgttgcggtttgcctgcctgttgccagtagtgttttgcgactatgagggagtgcaaatagtcgtcggcgaagtgtgctgtttctcctccggggatgcctttgccgatttggaagtctcctgccccgatgacgaaggccgcagtgctgtagtcggtgcgggtgtcttgttcgggttttggtggctgccattcggctagtttatctacgagttcgtctacagggtaggggtttgttgcgggttggtggtcgatgattttttgtacggatcggccggtttctccgttcggtaaggtccattcggagatgcgtgtgcggcgtacagtaccattggctagattgtcgtcgatggtgtcgatggcgttgtcgtggttggctagctgtgtgagtagccggtctatattgtctatcactgggtatcctcttcctcgtgtggggtggtgttggcttgtttgcggcgatagtctttaataacggtggcggagatggggtatccggcttgggtgagctgttttgctagccatgaggcggggatggttttgtcggcgaggacgtctgcggctttgttgccgtagcgttggataagggtttcagttttggttgccatgatatcctaggggttgtgtggcgggttgccatcctgtgcggcagtcgccgtcgtgtcctggcttacgggtgcaccatgtgatggttccgtctgtgtggtggagttttttgccgcacatgacgttttgtagatgctccggcagctggtcggtgttgttgctggtttgtatgtcgaagagtgttttctggttggtgaaatgctctgacacggtgccattatgcacgggtagtatccatgttttccattgctgttgtagcctggtgttccagtggaattgtttggcggcgttttcggcctgttttaaggttttgtagtagccgactagtatgcgctggtgttcactgtcgggtgggttttggcctcgccaatattgtgccgccacggcgtagcggttgctggctgtgaaggcgtcccagcagtattcgataatgtgttgtagtgcactatcgggcatgtcttgtatttggttttcgttaagccattcttcaacaaggatgttgtgtatggcgcgtttgtctttgatggttggtttgaacgagatgctcacgatagtaccggctggtcgtcttgcatgaactggttgaaggtgttgtttccggcgtgttgggcttgtgtgatgtcctggtcggtccagtcggggtgttgctgtttcagatagtgccagtggcacgcattgtaggtttcgtcttgtagccgtgtgagatggttttcggtgatgatttgtttccacattgtccatgacacgtcgagccggttgaggatttcgagggctgggatgttaaattggttgaggaagagtatttcgtgggtgtagtagtttttctcgtaggcgtcccatccgcttcggtgcctgttgggctggtttttggggtaggcttcccggcatactttgtgcaaatgtttggccatgtcgtcgggtagtttaatgtcggggttggcgcggatcatggatcgcataccatcataggtggtgccccaggtgtgcataatgtaggtggggttttctccatcagcccatttttctgcacagatggcgaggcggatgcgcctcctggctgcttggctaatgttgcgccggttggggatggggcacgtgtctaggggatccatgatgttttagtgtacctttctttgttggggttgcttgtgtggttttattgtagcactgtgttgagtgcttgtgtcaaccctgttttgccggcctgaaggtaggtgtctgtgacatcccccagggtgaggggcacgtgtacggcttgggggagtgctgtttggagggtttgggccatcttgtctcccgcggggtcgggatcggaccagatgtaaacatggtcgtagccttcgaagaatttggtccaaaagttttgccacgaggttgcgccgggtatggcgacggccgaccatccgcattgttcgaggatcatggagtcgaattcgccttcgcaaatgtgcatttcggctgccgggttggccatggcggccatgttgtagatggagcccgtgtctccggccggggttaagtatttggggtggttgtgttctttgcagtcgtgtgggagtgagcagcggaaacgcatttttcttatttcggctggccgcccccaaacggggtacatgtaggggatggtgatgcactggttgtagtcttcgtggcctgggatggggtcattgtcgatgtatccaaggtggtggtagcgggctgtttcttcgctgatgcctcttgctgagagaaggtcgagaatgttttcgaggtgggtttcgtagagggccgaggctttctggattcggcggcgttccgcaatgttgtatgggcgtatgctgtcgtacattcgggtttctttcttcgagttgttgttgtagtttggcgaggccgcctccgacaccgcatgtgtggcagtaccagacgcccttgtcgaggttgatgctcatggagggttggtggtcgtcgtggaacgggcagaggatgtgttgctcgttcctggacgggttgtagcgtatccggtaggtgtcgaggaggcggcaggtgtcagaggtgtgggaggagttctgcgagggttgataccacataggcttcgctccatggcttgttgcgctgtttcatgaccactaacccgattgtggatttgtcaaccaggttgcggtgggtttcatagttgcgcgcctcccggctggcttgtttcacgaattgggcgagatgttgctgtcctgctttcgcttcgatcacataggttttgtggccggttgtgaggatgaggtcgccttcgtcttcgtggccgttgaggtgtagccgttcgatgtcgtgtccgatgtcacgtagctggtgcaataatcgtgtttcccactcggcaccggcccggcggttgcgtgattgctgtgtagccatcataatcctttgtgtgttgtggccatgttccatggctgtttttcggctagtggtccgaagaatgtgtattcggggtaggctcgtagccgttcgtatcgggtgccgtctgggctggatttgcctgtgcgctgtttcaacactgcgatgcgcgcctctgccggtatcgatagcccgttgccgttatcctcgccaccatacaatgagactccgaggatgagttgtggtttctcggatagcccgtttttgatctctcgtctggcgggcgggtgttcgatgtcggagccggttttgtcggttgcgtggtgtgtgacgataatggtggagccagtatccctacctaatgctgtgatccattgcatggcttcttgctgtgcctggtagtcactctcgcagtcttggatgtccatcaggttgtcgataacaatgagtggtgggaaggtgttccacatttccatgtaggcttgcagctccatggtgatgtctgtccatgtgatgggtgactggaatgagaatgtgatgtgttggccgtggtggatgctgcctcgatagtattctggcccgtagtcgtcgatgttgtgttgtatttgggcggttgtgtgttgggtgttgagggatatgattcgtgtggaggcctcccagggtgtcatgtcccctgaaatatatagggcgggctggttgagcatcgcggtgatgaacattgctagcccggatttttggctgccggaccgccccgcaatcatgacgagatcccctttgtggatgtgcatgtcttggttgcggtagaggggttctagttgtggtatacggggcagctcagcagcggtttgggaggctctctcgaaggatcgttgtagagagagcatcgggaccttaatctatctatctgttacggtttggatgaatattggcggtcagatggagtcgatatctacatcatcgctgccggtggtgttgggctggctgtctcgctggtcaacgtaggcggctacaaggtcgtagatggcgtcgtctaggggtttgaggatgacagcgttgaacccgtttttagtgcgcactgtggcgagtttgaaggcctgctcctcgccgaggtaggtttcgagttcgcggatcatggagtgtgggcggtcgttgttgcctcgcgctttttcgatgatagcgttggggatggtttctggggtgccgttgttgaggtcgtcgagggtgtggaagatagtaacgtcggcgtaaatacggtctgcgacctgtccgccgtagccttcggtgttgtgttccacgtcgtggattttgaaggcgatggcggtggcgtcctggtttttggacgggttgaagaaggtgctgctgttgctgttgttgcggtagttggcgagtcccataacttttgtccttttgctgtttgtgttgttttgttgtcttatattggtttatcgggtgaggctgtttcgtttagtgcggaacgcctcagacacgtcactgttactggtgatgatctttttgtactgtttcaagaggtctgctaattgtgctttactggtggctttgttgatcctgtcgatgataatgtcgttttcttgattggcgattttgttgacgtagtctttggctgctttgtcgtatcggtcttggaggatgatggatgcgctcgctacgagcgttgccagatcccagtctttggagactgtttcgtctttgagtccgcctagcaggtcgatgatggcctgttttgtctgctctgctgtgtctcctcggatgaccgcccatggtgcagcatagtctccaccatatttgagtgtgatagtgagtcgatcattgtctgtggtgcgctcttctgtcacttgttttccttttctttattgtctgcttggggtggctgtacggtggattctaccgggtatctgtaggcgtctttcccgtctaccgcccagcaggcgtcctgtacggggcatcctttacagagtgctgtaacatgtgggacgaagatgcctttgctgattcctttcattgcttgactgtacatggatgatacatgccggtaggtattgttgtcaagatcgtacagttcggttgctgtgccctgagtttgcgatgtggtgttgtttcggctgctggcgggtgtccaaaacatgcctttcgtcacgttgatgtcgtgttggttgagcatgtaccggtaggtgtgcaactgcatggcatcaacagggaggcgacccgttttgaggtcgagaataaacgtctcaccagtgtcggtgtcggtgaagatacggtcgatgtagccaacaatctttgtgccgtcctggagggtggtttcgactgggtattcgatgcctggctggccgtcgagtattgctgtgtggtattgtggatagtttgtgcgccactgtttccacctgtcgacgaagatggggccatagatcatccaccagtcgtagtctttcttgtgtggcccgcctgactcgcacatgtttttgcacactctgccggagggtttgatttctgtgccttcggattcgacgagggcaacttgggtgtcgaaaacgtttttgaaggatgagagtttgtctggcagtgcagggtattcgtcggggttgtacaggtggaggtcgtactgttcggtgatgtggtgtatggcgcttccggcgatggttgcgtaccaggtgtggtgctgtgcatgatagccgtgggataggcgccatttttctccgcattcggcccactgggtgagtgaactgtaggagatgtggcctggatggttgatggttttcggatattgtgctagaggcattacttgtcgcttttgttccatgggttgcgggtgtcttggccggcattgtgttgctggtaggcgaggagtgctaggcagtgccaggctgcgtgtgccaggtgtggcaggtgtgattcatcgtcgaggttgtttccttgctgccaggatagcacatggcggtagagggcgtcgacactgtgacaccaggggtatcctccggtccagttgttgtcgccgtatttggtggcaccgtagcctgctacttcgcctagggcgtgcaaggctacggggtcaatgagggagagcctgcagagtttgagttcttttcgggcacctgtgtcggggtcggtgtacatgcgggtgggctcatccatggggggtgtgtgcctttcttggtttgggttactggttgttgtcgtgggctagtgctactgcgagaataatgatggcgagggtttcagcaataagtatgggtgttgtgatcatttgctgtctcggggattgttggtgagggttgaggcacccaggagggtggcgagggcgcatgcggcgataatggcgagggctgccttgtggggggtgccggttgcgtacatccatgtgatgatgccgccttggatccatgccagtgtggtgaagaaggtttcgtaactgtgcaactcgatactgttgggtgtgttcatgctcgctcctgaagaatggtgttgatggttttgtaaatgttgtacaggtcggtttcgatagataacagttggtggatttggtggtcgaggttgatatctgggttgagggtgttgatgcgggatgcgatgtcggtggctgtgcgtagtgtgccgccggtgtggtgaataatgtgtgcggtgtcggcgagtccggtggtgacagcatagtgggagaggagaggcatagcggggatgctccttggcgggttactgttgcgggttgatgttgaggtcggtgacgtgcgggtggtcttctgttcctgtgatgaggcagtggacggtgactgggagtttggatgcgccgggctgtttcatggttgcgccgtagacgatgctgaacgtgtctttaccgatggttttgtggagttggaggtcgatgtcggggttgccgttccagttgacgccgtgtgcggcggccttctgttcggctttacggttgcaggtgtgtgctgcggtgatcatggtgagaccctgcgcggtttcttcaccccttgcttgggcttgcttgtgggttttggcttgttcggcttgtagggagcgggtggcggctgcctgccgtgccgctttctcggctttgcgctgttgggcggtttttggtgtccattctgtgttggctgtggttacctgtggtgcgggttgtgatgcgagtggggggttgtcgtcgggggctgggaggaaggatgcggcggcgatgatggcggctgtgattccggcgatggtgtagccgtttttcttgttcatgactgttatcccctttccggggtgttgttcgttgctgacatgattgatacttccagacggggctatgactgtcaaggtgtcgctcagtttgtgtgagcgatccttgtgtggctgggggttatcgggcgaacagggtgagtaggtgtcctaagttgatgcgactcacgttccagtagagttgcgtggcttcaccgccagtgagcggcttccacttgttgtggctgaacactgtaccgtcggatgctatgaacgtgtcggggcgtagcttgtgaagttcagtctctacgctctgccggtaggcttcggcgaggccctcaaaatccatgtggtcaccggagaggttttcgaggcgtgtcaggtcgaagggtgtggggcagtcgtagctggcgggggtgtagagctgggtgaagtggtcggcgatcttttgcatcatgattccttttctagtgtggtgggttaatagttttatcgggtggatgcgacaaggatggcgtctatgtcgatcatgtcgatgagatcgtggagttcctcggcctcattctcagataggtggcgccagtcgtagtcgccgtacacggcgccgtcgagggtgacagtccacaggggccggatgagccgtatggcttcttgtactttggcgtggtacatgcggcgcaccatatccagatcgatgtcgtctgaatggtttccggtgaggctgtggagactgagggggtcgatttctgtctgctggtagaggctggtgaaggatggggtgatgagtgtgccatccatgggggggtgctcctttctggattgtttgggttggttgttgtggtttctaggatgtgtaggttgcgacccacagtcaaggctgcgctcaatccgaatgagcgtttagcgtgtgtggcatgggatgtggcgtatctcacttaagccttccttgcctctctaggcgtctcaaatcttctgggggtaggattatatagggttgaccctgctgatcgattctagagcacttctagggcctctcgggggtatgtctgagtgatgacgggtgtggcagatgatctagcgagtcaaggtgccgagcttagacataaaatctatcatctaggtgtgtgagatgtatcacatcctcctggcttggtgtgcactttcaaggctactctgtcgatctgacgtggagggtgtagcccagaaataccgtttaaagccactgggagacgcctagaagcgccttacggggtgggggctaggtatttatacccccagcatattctgatcgattctagacgcctacagaagcctggtacacgatcagctatccagacgcagaccatcagcccctatcccgcttagctaagcctgcactatgtggacattgttggatactgtagaggaaagaaggacacggtaaaggaaagagggggaatcagtcttagggtcttaggtacttcagttcaccttaggggcttagcgctgagcacttagcgctaagcccctcaagggctcggcatcagcctgacaggcttagcccatactgcacagccctgaaaggagtacacgccatcagggaaggcttgagagtacgaggagcctcagcgacgagtactcgaaagcctgagggaacacctttagcactgatgggcctagcgcgttcggaaagaacacagaagtaaagtgtgacagctgtccgggagtgaaccccgttctggctaggggtttcagtcttaactacctgtaaaggttacaagactctaagaaaatttaagaaaattcttaagaagaaagttgtgttgttatcccccaaaaaacacccgtttacacccctcaaacccgcctatagagccaaatccgccagtttgactcgtcccaggtggcgtatgctaggctggacaggtagccagctggacgcgaggccagaaagtgctgacgcacttcccgacctcgcttaccatcagtctaccaaacactttaaagcttcaaggctaagccactcagtgctaagcccttaagacctcaacgcttagcaccgagcccttgaggggctcagcattagcactaaggcttaaacacttaataatttaagtaaacataaaagcttttaagacttaaagtaaatatataaccttaacagttaaacgtttaaagctttaaaccttaacacctaagttaggtataaaaccttaaaggcttagcacttaaggatataaacttaacatcagtgtttaagactttaaaacttaaagtaactataagacttaaagacttataagctttaatacttatataataataaagtttaagactgatggttaactttaagtgtttaaagtcttatagttactttaagttttaaagcttataagttataaaagttttagaagagctaaggggttaacttctttacttctctactctctttggttctttctctcttctcttcttttcttcatcaggggagaagaggaacctttaccatcagcgctgatgggctttcacggtgtgtctcgtgtgtctctggtcgcaagctcccatcgcaccctcgccacccctcaccttgaccgtgtctcctttacagcttggtgtgttcggctgaaggcgtacggcgtgtcacgctaacacccttaacaccaggtaagacttaaagtgtatattatatgtagaagactttaaaaactttgaggatgtacacgttttggctgtgacctacaccgctaggcgctaggccttgaaacgcgaacacaccctcccccatttttcttccgtgtccttcttcttttgacacagctggggggcgatgtgatctttctcacatgcaggggtggagggtagaaaacaaccaccccaccacaaacagaacaccccaccaaacgaacaaaacagggcctagaatcgaccagcagggcaagggcaaggtattcatacccccaacgcatttcaggctgttacagaggcaatcagaggcttacagggaccataggtgaacgggaggcgcgatggcacacaccaaccgcaccgcatccgccgcccaccggcgctggcggcaacgactcatcacccaagcccgacaacaaggccaaaccgaatgtcccttgtgtggagccaccatcacctgggacacacacgacctaccaaccagccccgaagccgaccacatcacacctgtcagcaggggaggactcaacaccctcgacaacggccaaatcatctgcagaacatgcaacagaagcaaaggcaacagaacacaaccaaacattcgattccaacaacaaaccacaaaaacattgattccatggtgacaaaccccacaacccccaccggggacaccccctgcacacccgtgcaagacc

SEQ ID NO: 44 - DNA, 29451 bp, Unknown
  source: /note="Description of Unknown: Bacteriophage of P. acnes"
agtgaaatacctcccttttgtggatttatctgtttgtcgactttttgtgttggtggtgagtgttgtgcagcctgagcttcctgggtctcgtgattggtgtggggagacgcttcgctggtggcgtgtgtggggtgaggatagtcgcgcatcgtacgtgtcggatgaggagtggctgtttctcatggatgctgcggtgattcatgattgtgtgtggcgtgagggccgggctgaccttgtggcttcgcttcgtgctcatgtgaaggcttttatgggcatgttggatcgttattcggttgatgtggcgtctggtggccgtggtgggggttctgcggtggcgatgattgaccggtatcggaagcgcaagggggcctgattaggtgtctggtgttgttgggtctcaggtgcctcgtcaccgtgtggctgcggcgtattcggtgactgccggcggggatgctggggaattgggtcgtgcgtatgggttgatgcctgatccgtggcagcagcaggtgttggatgattggcttgctgtcggtggtaatggcaggcttgcttctggtgtgtgtggggtgtttgttccgcggcagaatggcaagaatgctattttggagattgtggagttgtttaaggcgactattcagggtcgccgtattttgcatacggctcacgagttgaagtcggctcgtaaggcgtttatgcgtttgaggtcgttttttgagaatgagcggcagtttcctgacttgtatcgtatggtgaagtcgattcgtgcgacgaatggtcaggaggctattgtgttgcatcatccggattgtgccacgtttgagcgtaagtgtggctgtccgggttggggttcggttgagtttgtggcccgttctcgtggttctgctcgcgggtttacggttgatgatttggtgtgtgatgaggctcaggagttgtcggatgagcagttggaggctttgcttcctaccgtgagcgctgcaccgtctggtgatcctcagcagattttccttggtaccccgccggggcctttggctgacggtagcgtggtgttgcgtcttcgcgggcaggctttgtcgggtggtaaaaggattgcgtggacggagttttcgattcctgacgagacggttccggatgatctatcgaggtcgtggcggaagttggctggggatacgaatcctgcgctgggtcgccgcctgaatttcgggacggtgagcgatgagcatgagtcgatgtcggctgccgggtttgctcgggagaggcttggctggtgggatcgtggccagtcggctacgtctgtgataccggccgataagtgggctcagtctgctgtggatgaggcgagtctggttggcgggaaagtgtttggtatctctttttcgcgatcaggcaatagggttgctttggctggtgccggcaggactgatgctggtgttcatgttgaggttattgatggcctgtcggggacgattgtggatggtgtaggccagctggctgactggttggcgttgcgttggggtgacacggaaaagatcatggttgccggttcgggtgctgtgttgttgcagaaggctttgactgatcgtggtgttccgggtcggggtgttgtggttgccgatactggggtgtatgtggaggcgtgtcaagcctttctggaaggcgtaaggtctgggagtgtttctcatcctcgtgctgattctcgccgtgacatgttggatattgctgtaaggtcggcggttcagaaacataaaggctctgcgtggggttggggttccacatttaaggacggttctgaggttcctttggaggctgtgtcgctggcgtattttggtgcgaaaacagttaaagcgaagcggcgtgagcgtagtggtaggaagcgggtgtctgtggtatgaactcggatgagttggctctgattgagggcatgtttgatcgtattaagagtttgtcttcgtggcattgtcgcattgagggctactatgagggttctagccgggtgcgtgatttgggggtagctattcccccggagttgcagcgtgtgcagactgtggtgtcgtggcctgggattgcggtggatgctttggaggagcgtctggattggctgggctggactaatggtgacggctacggcctggatggtgtgtatgctgcgaatcggcttgctacggcgtcgtgtgatgtgcatttggatgcgctgatttttggtttgtcgtttgtggctatcattcctcatggtgatggttcggtgtcggttcgtccgcagtcaccaaagaattgtactggccggttttctgccgatgggtctcgtctggatgctggccttgtggtgcagcagacgtgtgatcctgaggttgttgaggcggagttgttgcttcctgatgtgattgttcaggttgagcggcggggttcgcgtgaatgggttgaggtggatcgtataccgaatgtgttgggtgctgttccgcttgtgcctattgtgaatcgtcgccgtacttctaggattgatggccgttcggagattacgaggtctattagggcttacacggatgaggctgtgcgcacactgttggggcagtctgtgaatcgtgatttttatgcgtatcctcagcgttgggtgactggcgtgagcgcggatgagttttcgcagcctggctgggtcctgtcgatggcttctgtgtgggctgtcgataaggatgatgatggggacactccgaatgtggggtcgtttcctgtcaattcgcctacaccgtattcggatcagatgagactgttggcgcagttgacggctggtgaggcggctgttccggaacgctatttcgggtttatcacgtctaacccgcctagtggggaggctttggcggccgaggaatctcggcttgtgaagcgtgctgagcggcgccaaacgtcgtttggtcagggctggctgtcggttggtttcctggctgccaagtcgcttgattcttccgttaacgaagctgatttttttggtgatgttggtttgcgttggcgtgatgcatcaacacctactcgggcggctacagcggatgctgtgacgaagctggttggtgccggtattttgcctgctgattctcgcacggtgttggagatgctggggcttgatgatgtgcaggttgaggctgtgatgcggcatcgcgccgaatctgcggatccgttggctgcgcttgctggggctatttcccgtcaaacgaacgaggtttgatggatggcttcgggtgctatgtcgaggctggctgcgactgagtatcagcgtgaggcggtcaggtttgctgggaagtatgcgggctattattctgagcttggccgtttgtggcgtgccggcaggatgagtgacacacagtatgttcgtttgtgtgtggagttggagcgtgccggccatgatggttcggcgtcgttggccgccaggtttgtgtcggattttcggaagcttaacggtgtcgatcctggtttgattgtgtatgacgagtttgatgctgccgcggctttggctaggtcgttttcgactatgaagattatgaatagtgacccggatcgggcgaatgatacgattgatgcgatggcggcgggttttgatcgggctgtcatgaatgctggtcgtgacacggttgagtggtctgcgggtgcgcagggtaggtcgtggcgtcgtgtcacggatggggatccgtgtgctttttgtgccatgttggctacgaggtcggattatacgactaaggaaagggcgctcactactggtcatacgcggcgtcataagcgtggtggtaagcgtccgtttggttcgaagtatcatgatcattgtgggtgtacggtggttgaggttgttggcccttgggaaccgaatagggctgatgccgagtatcagaggacgtatgagaaggctcgcgagtgggttgatgatcatgggttgcagcagtcgcctggcaatattttgaaggctatgcgtactgttggtggcatgagataatttgatgtggtttccggttgtgcgccgccggttatcggtgcacagggttgtctcccgcacgggggtcaacaatgttgtgttgttttccgcaaggagtgtagggttaggctatggccgatcagagtgttgaggaacagaatgttgacaatgatgttgtggagtccggaaagggtgacggcattgttgacacggtgaagggcgatcaaggcaaacaggttgaagatcagtcgaagaatgaaggcgagggtaaatcgccggggactgattggaaggctgaggctcgtaaatgggagtctcgtgcgaaaagtaatttttccgagctggagaagcttcgtacatcgagtgacgattctggatctactattgatgagcttcgccgcaagaatgaggaactcgaagacaggatcaacgggtttgttcttgagggtgtgaagcgtgatgtggctgccgagtgtggcctttcgggtgatgctgtcgcttttctgcacggcgacgatcgtgaagcgctggtggagtctgctaaggctttgaagggtttgatcgaccatagtagtggtggcgcgggtgtgcgccgtcttgcggggagtgcccccgttgatgatgttaaacgacgtgagggtgtcgcgtttgtggatgctcttgtcaataattctaggagatgatttgtgatggctgacgattttctttctgcagggaagcttgagcttcctggttctatgattggtgcggttcgtgaccgtgctatcgattctggtgttttggcgaagctgtcgccggagcagccgactatttttggccctgtgaagggtgccgtgtttagtggtgttcctcgcgctaagattgttggtgagggtgaggttaagccttccgcgtctgttgatgtttcggcgtttactgcgcagcctatcaaggttgtgactcagcagcgtgtttcggacgagtttatgtgggctgatgctgattaccgtctgggtgttttgcaggatctgatttccccggctcttggtgcttcgattggtcgcgctgttgatctgattgctttccatggtattgatccggctacgggtaagcctgctgcggctgtgaagacttcgctggataagacgaagcatgttgttgatgccacggattctgccacgactgatctggtcaaggcggtcggcctgattgctggtgctggtttgcaggttcctaacggtgtcgccctggatccggcgttctcgtttgctctgtcgactgaggtgtatccgaaggggtctccgcttgccggtcagccgatgtatcctgccgccgggttcgctggtttggataattggcgcggcctgaatgttggtgcttcttcgactgtttcgggtgccccggagatgtcgcctgcctctggtgtgaaggctattgttggtgatttctctcgtgtccattgggggttccagcgtaacttcccgatcgagctgatcgagtatggtgacccggatcagactggccgcgaccttaagggccacaatgaggttatggttcgcgccgaggctgtcctgtatgtggctatcgagtcgcttgactcgtttgctgttgtgaaggagaaggcttccccgaagcctaatccgccggccgagaactgatttatttgttgcgataatgttcatgctgtgtgcagggggtggtgttgatgggtatcattttgaggcctgaggatattgagcctttcgccgatattcctaaagataagcttgaggcgatgattgccgatgtggaggctgttgctgtcagtgtcgccccctgtatcgctaaaccggatttcaaatacaaggatgctgctaaggctatcctacgtagggctttgctgcgctggaatgatactggtgtttctgggcaggttcagtatgagtctgcgggcccgtttgctcagactacacggtctagtactcccacgaacttgttgtggccttccgagattgccgcgttgaagaagctgtgtgagggtgatggtggggctggtaaagcgttcactatcacaccgaccatgaggagtagtgtgaatcattctgaggtgtgttccacggtgtggggtgagggttgctcgtgcgggtcgaatattaacggctacgctggccctttgtgggagatatgatatgaccagttttccttacggtgaaacggttgtgatgcttcagccgactgttcgtgtcgatgatttgggcgacaaggttgaggattggggtcatcctgtagaaaccgtgtaccataacgtggctatctatgcttccgtttcgcaggaggatgaggccgcggggcgtgattctgattatgagcattggtcgatgcttttcaagcagcctgttgtgggcgctgattatcgttgtaggtggcgtattcggggtgtggtgtgggaggctgacgggtctcctattgtgtggcatcacccaatgtctggctgggatgctggtacgcaggttaatgtgaagcgtaagaagggctgatggttgtggcacgtgatgtgaatgtgaagcttaatcttcctggtatccgtgaggtgttgaagtcttctggggtgcagggcatgttggcggagcgtggcgagcgtgtcaagcatgcggcctctgctaatgttggcggtaatgcttttgatagggcccagtatcgtgccgggttgtcgtcggaggtgcaggttcaccgtgttgaggctgtcgctaggattggcaccacctataagggtggtaagcgtattgaggcgaagcatggcacgttggctaggtcgattggggctgcgtcgtgatcgtttacggtgatccgcgaatatgggcgaaacgcgtgctcaaggatgatggctggctgtccgatataccgtgtacaggtactgtcccggatgatttcacgggtgacttgatttggttggcgttggatggtggcccgcagttgcatgttcgtgagcgtgtttttttgcgggtgaatgtgttttctgatatgccggatcgtgctatgtctttggcgcgtcgtgttgaggctgtgctggctgatggtgttgatggtgatccggtggtgttttgtaggcgttctactggtcctgatttgttggttgatggtgcacgttttgatgtgtattcgctgtttgagctggtgtgccgtcctgtcgaatccgagtaaacgtatttgttttctatattttgtttttgtttgattatttttgggggttgtgatggctgctacacgtaaagcgtctaatgttcgctctgctgttacgggtgacgtctatattggtaaagctcatgccggtgacactattgatggtgtgaagacggttcctgacggtcttaccgctttagggtatctgtctgatgacgggtttaagattaagccggagcgtaaaacggatgatttgaaggcttggcagaatgcggatgttgttcgcactgtggctacggagtcgtctatcgagatttctttccagctgatcgagtctaagaaggaggttatcgaactgttttggcagtcgaaggttactgccggagccgattcgggttcgttcgatatttctcctggtgccacgacgggtgttcatgccctgttgatggatattattgatggcgatcaggttattcgctactatttccctgaggttgagttgattgatcgtgacgagattaagggtaagaatggcgaggtgtacgggtatggtgtgacgttgaaggcgtatcctgcccagattaataagaatggtgatgcggtgtcgggtcgggggtggatgacggctttaaaagctgatactcctccgactcctcctccggccccgaagcctccgaagcctgagccggatccgaatccgccgtctaataactgatacacatagtttgagggattgttgatagatgagtgacacaggttacacgttgaagattggtgaccgtagctgggtgttggcggatgcggaggaaacggcgcaggctgttcctgcccgcgttttccgtcgtgccgccaggattgcccagtcgggggagtctgcggatttcgcccaggttgaggtgatgttttctatgttggaggctgccgccccagaggatgctgtggaggccttggaggggcttcctatggttcgtgtggccgagattttccgccagtggatggaatataagcctgaaggtaagggtgcctcgctgggggaatagtttggctccacggcctgattgatgattatcgtggggccatcgaatacgatttccgcactaaatttggtgtttctgtttatagtgttggtggcccgcagatgtgttggggtgaggctgtccggctggctggcgtgttgtgtaccgatacgtctagccagttggcggcccacctgaatggttggcagcgcccgtttgagtggtgtgagtgggctgtgctggacatgttggatcattacaggtctgctaatagtgaggggcagccggagcctgtggcgaggcctacggatgagcgtagggcccggtttacgtctgggcaggtggacgatattttggcgcgtgttcgtgccggcggcggggtgtctcgcgagattaatattatggggtgaatagtgtatgtctggtgagattgcttccgcatatgtgtcgttgtatacgaagatgcctggccttaaaagtgatgttggtaaacagctttctggggttatgcctgctgagggtcagcgttcgggtagtctttttgctaagggcatgaagttggctcttggtggcgccgcaatggtgggtgctatcaatgttgctaagaagggcctcaagtcgatttatgatgtgactattggtggcggtatagctagggcgatggctatcgatgaggctcaggctaaactgactggtttgggtcatacgtcttctgacacgtcttcgattatgaattcggctattgaggctgtgactggtacgtcgtatgcgttgggtgatgcggcttctactgctgccgcgttgtctgcttcgggtgtgcagtctggcgggcagatgacggatgtgttgaagactatcgccgatgtgtcttatatttcgggtaagtcgtttcaggatacgggcgctatttttacgtctgtgatggctcgcggtaagttgcagggcgatgacatgttgcagcttacgatggcgggtgttcctgtgctgtctttgcttgccaggcagacgggtaaaacctcggctgaggtgtcgcagatggtgtcgaaggggcagattgattttaacacgtttgcggctgcgatgaagcttggcatgggtggtgctgcgcaggcgtctggtaagacgtttgagggcgctatgaagaatgttaagggcgccttgggctatcttggtgctacggctatggccccgtttcttaacgggttgaggcagatttttgttgcgttgaatccggttattaagtcggtcacggattcggtgaagccgatgtttgctgccgtcgatgctggtattcagcgtatgatgccgtctattttggcgtggattaatcgtatgccgggcatgattacgagaatgaatgcacagatgcgcgccaaggtggagcagctgaagagcgtttttgcgagaatgcatttgcctgtcccgaaggtgaatttgggtgccatgtttgcgggtggcacagcagtgtttggtgttgtggctgcgggtgtggggaagcttgttgcagggtttgccccgttggcggtgtcgttgaagaatcttctgccgtcgtttggtgctttgaagggtgccgctggcgggcttggcggcgtgtttcgcgccctgggcggccctgtcggtattgtgatcggcttgtttgctgccatgtttgcgacgaacgcccagttccgtgccgcggtgatgcagcttgtggctgtggtgggccaggctttggggcagattatggccgctattcagcccttgtttggtttagtggccggtgttgtggcacagttggcgccagtgttcggccagattatcggtatggttgccggtttggctgcccagattgtgcctttgattagtatgcttgtcgcccggctggttcctgtgattacgcagattattggtgcggtgactcaggttgctgcaatgttgttgccggcgttgatgccggtgcttcaggcggttgtggctgtgatacggcaggttgttggtgttgtgatgcagcttgtgcctgtgttgatgcctgtgattcaacagattttgggtgctgtgatgtctgtgttgccgccgattattggtttgatacggtcgctgataccggtcatcatgtctgttatgcgcgtagtggtgcaggttgtttcggttgtgttgcaggtggttgcccgtattattccggttgtgatgccgattgttacggctgtgatcgggtttgttgcacgtattttgggtgctattgtgtcggctgccgccaggattattggggctgttgcccgtgttgtcggatgggttgtgggccatttcgtgtcgggtttggcgcgtatgggttcggttattcaggctggctggaatcatattagggcttttacgtctgcgtttattaacggtttcaagtcgatcatttctggcggcgtgaacgcggttgtcgggttttttacgcggcttggtttgtcggttgcctcccatgtgaggtctggttttaacgcggcacgtggtgctgtttcttctgcgatgaatgctatccgtagtgtggtgtcttcggtggcgtctgctgttggcgggtttttcgggtcgatggcgtctagggttcggaatggtgctgtgcgcgggtttaacggggcacggagtgcggcctcttctgctatgcatgctatggggtctgccgtgtctaacggtgtgcatagtgtactgggttttttccggaatctgcctggcaatattcggcatgctctcggcaatatggggtccctgttggtgtctgctggccgtgacgtggtgtctggtttgggtaatggtattcggaatgctttgagtggcctgctggatactgtgcgtaatatgggttcccaggtggctaacgctgcgaagtctgtgttgggtattcattccccgtcgagggtgtttcgtgatcaggttggccgtcaggttgttgccggtttggctgaggggatcaccgggaatgctggtttggcgttggatgcgatgtcgggtgttgcttcgcagcttccggatgctgtggatgcccggtttggtgtgcgatcgtctgtgggctcgtttaccccgtacgaccggtatcggcgtgctcagggtgagagtgttgtggtgaatgtgaatggcccgacgtatggtgatcctgccgagtttgcgaagcggattgagcgtcagcagcgtgacgctttgaacgcgttggcttatatgtgagtaaaggggtatgcatgtttattcctgacccgtctgatcgttctggtttgactgtgacatggtctatggatccgcggtttggtgatgagcgtgtgcttcatttgacggattatacggggtcgtctccggtgatgttgttgaatgattcgttgcgcggtttgggtgttcctgaggttgagcatttttctcaaactcatgttggggtgcacgggtcggagtggcgcgggtttaatgtgaagcctcgcgaggtgacgttgccggtgttggtgtcgggtgttgacccggatccggtgggcgggtttcgtgacggttttttgaaagcctatgacgagttgtggtctgcgtttcctcctggcgaggagggggagctgtctgtgaagactcctgccggtgtagagcgtgtgttgaagtgccggtttgattcggtggatgacacgtttacggttgatccggttaatcgtggctatgcgcgttatgtgcttcatttgacggcctatgacccgttttggtatggggatgagcaaaagtttcgtttcagtaacgcaaagttgcaggattggttgggtggcggccctgtcggcaaaaacgggactgcttttccggtggtgttgacgcctggtgttggttcgggttgggataacctgtcgaataagggtgatgtgcctgcgtggcctgtgattcgcgttgaggggccgttggattcgtggtcggtgcagattgatggtttgcgtgtgtcttcggactatcctgtcgaggagtttgattggatcactattgatacggatcctcgtaagcagtctgcgttgttgaacgggtttgaggatgtgatggatcgcctggatgagtgggagtttgcgccgattccgcctggcggttctaagagtatgaatattgagatggttggtttgggtgccattgttgtgtcggtgcagtacaggtttttgagggcgtggtgaattgttgtggctggtcttgtcccgcagataacattgtttacgccagactatcatcgtgtggcgcctatcaatttttttgagtcgctaaaattgtcgttgaagtggaatggtttgtcgacgctggagttggtggtgtctggtgatcattcgaggcttgacgggttgacgaggccgggtgcacgcctggttgttgattatggtggtggccagattttttctgggcctgtgcgtaaagtgcacggggttgggcctcggcggtcttcccgtgtgactatcacttgtgaggatgatattcgcctgttgtggcgtatgttgatgtggcctgttaattatcgccccggtatggtgggttctgagtggcgtgcagaccgggattatgcccactattctggtgcagccgagtctattgctaagcaggtgttgggggataatgcttggcgttttccgcctggtttgttcatgatagaggatgagaagcgtggccgctatattaaggattttcaggtgcggtttcacgtgtttgcggacaagttgttgcctgtcctgtcgtgggctcggatgactgtttcggtgaaccagtttgagaatgcgaagacggatcagcgggggctggtgtttgattgtgttcctgctgtgacgcgtagccatgtgttgacgtccgagtcgggttcgattgtgtcgtgggagtatgtgagggatgcccccaaggctacgtcggtggttgttggtggccgcggcgagggtcgggatcggctgttttgtgaggatgttgattcgatggccgagggggactggtttgatcgtgtcgaggtgtttaaggatgcccgtaacactgattcggataaggtgtctctttacgatgaggcggagcaggtgttgtcggaatcacaggccacgtctggttttaagatcgagttggccgagtcggatgtgttgcgttttgggcccggcaatctgatgcctggggatttgatttatgttgatgtgggttcggggcctattgcggagattgttcggcagattgatgtggagtgtgattcgcctggtgacggctggacgaaggtgacaccggttgcgggggattatgaggataatccgtcggcgttgctagcgcggcgtgttgccggtttggctgccggtgtgcgggatttgcaaaagttttaaaaaagctcaacggattggggtttgttgtgggtattgtgtgcaagggttttgatggtgtgttgaccgagtatgattgggctcaaatgtctggtctgatgggtaatatgccgtcggtgaaaggtccggacgattttcgtgtcggcacgacgattcagggtgccacagtgttgtgtgaggttttgccggggcaagcgtgggctcacggggtgatgtgtacttcgaatagtgttgagacggtgacgggccagctgccgggtcctggcgagacgagatacgactatgttgttctgtcgcgggattgggagcagaatacggcccggttggagattgttcctggggggcgtgcggagcgtgccagtgacgtgttgcgtgccgagcctggcgtgtaccatcagcaactgttggctaccctggtgttgtcgtctaacgggttgcagcagcagctggataggcgtgccgtggcggctagggtggcgtttggggagtctgctgcgtgtgaccctacccctgtggagggtgaccgggtgatggttccttcgggggctgtgtgggctaaccatgctggcgagtggaggctgttgtctccgcgtatcgagacgggttcgaagtcgatcatgtttggtggatctaatgtgtatgcttacacgatcccgtttgatcgccagtttactagtccgcctgttgtggtggcgtctatggggaccgcggctgggggtacgacacagattgatgtgaaagcctacaatattactagtaaggattttggtttggcgtttatcacgaatgacgggtctaaaccgaatggtgtgcccgcggtggctaactggatagctgtgggcgtgtgacggtacaggcgttgtggtggctggtgtgatgttggggggctgccgtgtcgtggatgactcctgcattggtggcttctatttgtaccgcgttggccacggttttgggttctgttcaggctatcacatcccggtctagaaagcgtttgcgaaggttgtctgcgcaggtggatgctttggaagagtatacgtggggtgtgcggcgtgaggttcgccggtttaacgccaggcttcctgacggggttgatccgcttgtgttgcctgagccgcctggttatcggatgatgttgggggtgagtgatgagggagttggaggaggagaagcggcagcgtcgctcgtttgagagggcttccctgctgttgttgtttttgtcgcttgtgctgttgattgtggttgctgggggtgctttgcgtttcggggctgtatcctctgaacgggattctgagcaggcgagggcccagtcgaatggtacagcggccaggggtttagccagccgtgtgcggcaggtgtgtgcccatggtgggatggagtcggtacggcttcaccggtctggtttgtgtgtggatgctgtgcgtacggagcggagtgttcagggtgtgccgggcccggctggtgagcgcggcccgcaaggccctgcaggtgctgatgggcgtgacggtgttaatggttcgtctgggctggttggccctgttggtccgcagggttctcccggcttgaatggcgtgaaaggtcctgacgggttgcctggtgcaaatggatcggatggccgtgatggtgttccgggccgtgcaggtgttgacggcgctgatggtcgggatggttcggctggtgagcgcggtgatgtgggtccttcaggtcctgccggcccgcaaggtgcacagggggaacggggtgagcgtggccccgtcggtgcgaacggatccgatggtaaagatggtaaggatgggcgctcggtggtgtctgtgtactgttctgatggtctcctggttgtgaaatatagtgacggtgtggcttctacaatatcgggctcggtggcctgccagggtgtgaaaccgtcgcctatggtgactatatcatcccacaaatagaaaggagtggctgtgatggtagtgtttggtggtggtgtgtggtgaggtttatcccagcagcgcaccattctgccggttcgaatagtccggtgaatagggttgtgattcatgcgacgtgcccggatgtggggtttccgtccgcctcacgtagggggagggctgtttctacggcaaactattttgcttccccatcgtctgggggttctgcccattatgtgtgcgatattagtgagacggtgcaatgtctgtctgagtctacgattggttggcatgccccgcctaaccctcatagtttgggtatagagatttgcgcggatggtggctcgcacgcctcgttcagggtgccggggcatgcttacactcgtgagcagtggcttgaccctcgcgtgtggcccgcggtggagcgtgccgcgatcctgtgtagacgtttgtgtgacaaatataatgttccgaaaaggaagcttagtgcagccgatttgaaggctggcaggcggggtgtttgcggccacgtggatgttacggatgcgtggcatcagtcggatcatgacgatcctgggccgtggtttccgtgggacaaatttatggccgtagtctgcggcggtagtggtagtgaggagttaactgtggctgatgtgaaagccttgcatgatcagattaaacaattgtctgcccagcttactggttcggtgaataagctgcaccatgatgttggtgtggtacaggtacagaatggtgatttgggtaaacgtgttgatgccttgtcgtgggtgaagaatccggtgacggggaagttgtggcgcacgaaggatgctttgtggagtgtctggtattacgtgttggagtgtcgcagccgcattgacaggcttgagtctactgttaacggtttgaaaaagtgatggtggtttgttgtgggtaaacagttttggttaggtttactggagcgggccctgaaaacttttattcaaacgtttgttgccgtgctcggtgttactgcgggtgtcacgtatactgcggagtcgtttcgcggtttgccgtgggagtcggcgttgatcacagccacggttgctgcggtgttgtcggttgctacttcgtttggtaatccgacgtttgtggctggtaagccgaagactacggttgtggataccgggcttgttccacccgatgataccggtttgatagaaccgcatgcggtggatgtgtcggatcctggcatgattgagccgatggatgatgcggatgttgccggctatgtgccgaagcgggctgccgagtcggaggttggcacagtagagtctactgttgcataattgaatatgtgtgtgccccagcggtgctgccacgattgtgtggtggttgccgctggggcacactttttgtttatgcgatatggctatgattcgttgctgtcgatggtgtcttcgagcatctgatacaggtggaggcaggtgcagatggtttcgctggcctggtcgagaacgtttcggccgataacgtttttgtggttgtcgcggtggcggatgatagcccacatgatctcgtcggctgccgcctgtaatagttttgcctggtatgcgattccggcgagccagtctagtgcttcctggcttgcctgtgtgtcgtctggaataccacgggtgttgctgttgcttgggtgtccttcactgtcgcatagccacaggatttcgctgcactcgtctagcgtgtcctggtcgatagcgagatcgtcgaggctgacattgttgacggtaaggttcacgttgtcgagggagatgggtacaccgtactggttttcgacactgtcaacaatgttttgtagttgttgcatgttggtgggctgttgttggatgatacggtgtaccgctgctttgagggcagtgtaggggatattgtgtgtgttgttcatggttttatttcatccctgtgctgtcgtcgttatcgtctggatagtatctactgtttgcgtaccctgttagggtgatcaatgtttggtctgcccactgtttcacggtttgccgggttacccctaatcgttgggctgctaccgaataggtttgatcatacccgtatacttcccggaatgctgccaaccgtgctaggtgttttcgctgtttggatggctggcaggtgagggtgtagtcgtcgatggccagctggaggtcgatcatggagacgatgttgttgccgtgatgctggggggcggttggtgggggtggcataccgggttctactgatggtttccatgggccgccgttccagatccattgggcggcttggataatatctgcggtggtgtaagtccggttcactggtcaccccctgaacaggttgtcgaggttgtctgggttactggtgttggtggtgtcgaatcgtcccacacagtggcagtagtcgtacatgagtttgataatgtgttggtggtcgccgaggtaggtgttgccactaatactgtaggtggctgtgccgtctttgccgataatgtatttggcggtgatggtttctggtgtttcggtgttggtgatgattgctgttgtggtggtgcctacggtttgtagcctggtggtttgggttccgtcgtcgagggtggtggtaaccataattggggttttccttaaatgcttgtctggttgtcggctagatgaataatatcggataaaggtttcggctggtctaggtgctgtaccgctttgttggctaaacgtttggctaccctgtaacacattttggtatagtgtttgttgtctaggttgtggtattgttcccgcaccgcaatatatagtagggagtcttggtacaggtcgtctgcactgattgcggggtagtgggtggctactttgatgcatgaccggttgagtgtgcgaagatgatggtcggtggtccatccccacgatgcggtggtggcccggtctgcttttgttggtcgtctactcatggcactatttcatctcgctatctggtagttgtttggtgttttatggttgatagtgtagcacacgagtccggggttgccggtggtgcccgtcttgtgccggtaccatgtggattcgccttccatggatgggcattggatgaaggtgcgttgtccttgctcggagatttctaggtggtgtcggtgcccggccatgaggatgtgggatgtggttccgttgtggaattcttgtccgcgccaccaatcatagtgtttgccggtgcgccattggtgtccgtgggcgtgcaggatttgtgtgcctgccacattgacggtggtggtcatttcgtctcggctggggaagtggaagtgtaggttggggtattggttgttgagttggtaggcttcggcgatggcgcggcagcagtccacgtcgaaggagtcgtcgtaggtggtgacgcctttgccgaagcgcacggcttcaccgtggttgccggggatggatgtgaccgttaggttggcgcagtggtcgaattggtggatgagttgcatcatggccatgcgggtgagccggatttgttcggtgaggggtgtttgtgtgcgccaggcgttgttgcctccttgtgacacgtatccttcgatcatgtcgccgaggaatgcgatgtggactcgttgcggtttgcctgcctgttgccagtagtgttttgcgactatgagggagtgcaaatagtcgtcggcgaagtgtgctgtttctcctccggggatgcctttgccgatttggaagtctcctgccccgatgacgaaggccgcagtgctgtagtcggtgcgggtgtcttgttcgggttttggtggctgccattcggctagtttatctacgagttcgtctacagggtaggggtttgttgcgggttggtggtcgatgattttttgtacggatcggccggtttctccgttcggtaaggtccattcggagatgcgtgtgcggcgtacagtaccattggctagattgtcgtcgatggtgtcgatggcgttgtcgtggttggctagctgtgtgagtagccggtctatattgtctatcactgggtatcctcttcctcgtgtggggtggtgttggcttgtttgcggcgatagtctttaataacggtggcggagatggggtatccggcttgggtgagctgttttgctagccatgaggcggggatggttttgtcggcgaggacgtctgcggctttgttgccgtagcgttggataagggtttcagttttggttgccatgatatcctaggggttgtgtggcgggttgccatcctgtgcggcagtcgccgtcgtgtcctggcttacgggtgcaccatgtgatggttccgtctgtgtggtggagttttttgccgcacatgacgttttgtagatgctccggcagctggtcggtgttgttgctggtttgtatgtcgaagagtgttttctggttggtgaaatgctctgacacggtgccattatgcacgggtagtatccatgttttccattgctgttgtagcctggtgttccagtggaattgtttggcggcgttttcggcctgttttaaggttttgtagtagccgactagtatgcgctggtgttcactgtcgggtgggttttggcctcgccaatattgtgccgccacggcgtagcggttgctggctgtgaaggcgtcccagcagtattcgataatgtgttgtagtgcactatcgggcatgtcttgtatttggttttcgttaagccattcttcaacaaggatgttgtgtatggcgcgtttgtctttgatggttggtttgaacgagatgctcacgatagtaccggctggtcgtcttgcatgaactggttgaaggtgttgtttccggcgtgttgggcttgtgtgatgtcctggtcggtccagtcggggtgttgctgtttcagatagtgccagtggcacgcattgtaggtttcgtcttgtagccgtgtgagatggttttcggtgatgatttgtttccacattgtccatgacacgtcgagccggttgaggatttcgagggctgggatgttaaattggttgaggaagagtatttcgtgggtgtagtagtttttctcgtaggcgtcccatccgcttcggtgcctgttgggctggtttttggggtaggcttcccggcatactttgtgcaaatgtttggccatgtcgtcgggtagtttaatgtcggggttggcgcggatcatggatcgcataccatcataggtggtgccccaggtgtgcataatgtaggtggggttttctccatcagcccatttttctgcacagatggcgaggcggatgcgcctcctggctgcttggctaatgttgcgccggttggggatggggcacgtgtctaggggatccatgatgttttagtgtacctttctttgtttgggttgcttgtgtggttttattgtagcactgtgttgagtgcttgtgtcaaccctgttttgccggcctgaaggtaggtgtctgtgacatcccccagggtgaggggcacgtgtacggcttgggggagtgctgtttggagggtttgggccatcttgtctcccgcggggtcgggatcggaccagatgtaaacatggtcgtagccttcgaagaatttggtccaaaagttttgccacgaggttgcgccgggtatggcgacggccgaccatccgcattgttcgaggatcatggagtcgaattcgccttcgcaaatgtgcatttcggctgccgggttggccatggcggccatgttgtagatggagcccgtgtctccggccggggttaagtatttggggtggttgtgttctttgcagtcgtgtgggagtgagcagcggaaacgcatttttcttatttcggctggccgcccccaaacggggtacatgtaggggatggtgatgcactggttgtagtcttcgtggcctgggatggggtcattgtcgatgtatccaaggtggtggtagcgggctgtttcttcgctgatgcctcttgctgagagaaggtcgagaatgttttcgaggtgggtttcgtagagggccgaggctttctggattcggcggcgttccgcaatgttgtatgggcgtatgctgtcgtacattcgggtttctttcttcgagttgttgttgtagtttggcgaggccgcctccgacaccgcatgtgtggcagtaccagacgcccttgtcgaggttgatgctcatggagggttggtggtcgtcgtggaacgggcagaggatgtgttgctcgttcctggacgggttgtagcgtatccggtaggtgtcgaggaggcggcaggtgtcagaggtgtgggaggagttctgcgagggttgataccacataggcttcgctccatggcttgttgcgctgtttcatgaccactaacccgattgtggatttgtcaaccaggttgcggtgggtttcatagttgcgcgcctcccggctggcttgtttcacgaattgggcgagatgttgctgtcctgctttcgcttcgatcacataggttttgtggccggttgtgaggatgaggtcgccttcgtcttcgtggccgttgaggtgtagccgttcgatgtcgtgtccgatgtcacgtagctggtgcaataatcgtgtttcccactcggcaccggcccggcggttgcgtgattgctgtgtagccatcataatcctttgtgtgttgtggccatgttccatggctgtttttcggctagtggtccgaagaatgtgtattcggggtaggctcgtagccgttcgtatcgggtgccgtctgggctggatttgcctgtgcgctgtttcaacactgcgatgcgcgcctctgccggtatcgatagcccgttgccgttatcctcgccaccatacaatgagactccgaggatgagttgtggtttctcggatagcccgtttttgatctctcgtctggcgggcgggtgttcgatgtcggagccggttttgtcggttgcgtggtgtgtgacgataatggtggagccagtatccctacctaatgctgtgatccattgcatggcttcttgctgtgcctggtagtcactctcgcagtcttggatgtccatcaggttgtcgataacaatgagtggtgggaaggtgttccacatttccatgtaggcttgcagctccatggtgatgtctgtccatgtgatgggtgactggaatgagaatgtgatgtgttggccgtggtggatgctgcctcgatagtattctggcccgtagtcgtcgatgttgtgttgtatttgggcggttgtgtgttgggtgttgagggatatgattcgtgtggaggcctcccagggtgtcatgtcccctgaaatatatagggcgggctggttgagcatcgcggtgatgaacattgctagcccggatttttggctgccggaccgccccgcaatcatgacgagatcccctttgtggatgtgcatgtcttggttgcggtagaggggttctagttgtggtatacggggcagctcagcagcggtttgggaggctctctcgaaggatcgttgtagagagagcatcgggaccttaatctatctatctgttacggtttggatgaatattggcggtcagatggagtcgatatctacatcatcgctgccggtggtgttgggctggctgtctcgctggtcaacgtaggcggctacaaggtcgtagatggcgtcgtctaggggtttgaggatgacagcgttgaacccgtttttagtgcgcactgtggcgagtttgaaggcctgctcctcgccgaggtaggtttcgagttcgcggatcatggagtgtgggcggtcgttgttgcctcgcgctttttcgatgatagcgttggggatggtttctggggtgccgttgttgaggtcgtcgagggtgtggaagatagtaacgtcggcgtaaatacggtctgcgacctgtccgccgtagccttcggtgttgtgttccacgtcgtggattttgaaggcgatggcggtggcgtcctggtttttggacgggttgaagaaggtgctgctgttgctgttgttgcggtagttggcgagtcccataacttttgtccttttgctgtttgtgttgttttgttgtcttatattggtttatcgggtgaggctgtttcgtttagtgcggaacgcctcagacacgtcactgttactggtgatgatctttttgtactgtttcaagaggtctgctaattgtgctttactggtggctttgttgatcctgtcgatgataatgtcgttttcttgattggcgattttgttgacgtagtctttggctgctttgtcgtatcggtcttggaggatgatggatgcgctcgctacgagcgttgccagatcccagtctttggagactgtttcgtctttgagtccgcctagcaggtcgatgatggcctgttttgtctgctctgctgtgtctcctcggatgaccgcccatggtgcagcatagtctccaccatatttgagtgtgatagtgagtcgatcattgtctgtggtgcgctcttctgtcacttgttttccttttctttattgtctgcttggggtggctgtacggtggattctaccgggtatctgtaggcgtctttcccgtctaccgcccagcaggcgtcctgtacggggcatcctttacagagtgctgtaacatgtgggacgaagatgcctttgctgattcctttcattgcttgactgtacatggatgatacatgccggtaggtattgttgtcaagatcgtacagttcggttgctgtgccctgagtttgcgatgtggtgttgtttcggctgctggcgggtgtccaaaacatgcctttcgtcacgttgatgtcgtgttggttgagcatgtaccggtaggtgtgcaactgcatggcatcaacagggaggcgacccgttttgaggtcgagaataaacgtctcaccagtgtcggtgtcggtgaagatacggtcgatgtagccaacaatctttgtgccgtcctggagggtggtttcgactgggtattcgatgcctggctggccgtcgagtattgctgtgtggtattgtggatagtttgtgcgccactgtttccacctgtcgacgaagatggggccatagatcatccaccagtcgtagtctttcttgtgtggcccgcctgactcgcacatgtttttgcacactctgccggagggtttgatttctgtgccttcggattcgacgagggcaacttgggtgtcgaaaacgtttttgaaggatgagagtttgtctggcagtgcagggtattcgtcggggttgtacaggtggaggtcgtactgttcggtgatgtggtgtatggcgcttccggcgatggttgcgtaccaggtgtggtgttgtgcatgatagccgtgggataggcgccatttttctccgcattcggcccactgggtgagtgaactgtaggagatgtggcctggatggttgatggttttcggatattgtgctagaggcattacttgtcgcttttgttccatgggttgcgggtgtcttggccggcattgtgttgctggtaggcgaggagtgctaggcagtgccaggctgcgtgtgccaggtgtggcaggtgtgattcatcgtcgaggttgtttccttgctgccaggatagcacatggcggtagagggcgtcgacactgtgacaccaggggtatcctccggtccagttgttgtcgccgtatttggtggcaccgtagcctgctacttcgcctagggcgtgcaaggctacggggtcaatgagggagagcctgcagagtttgagttcttttcgggcacctgtgtcggggtcggtgtacatgcgggtgggctcatccatggggggtgtgtgcctttcttggtttgggttactggttgttgtcgtgggctagtgctactgcgagaataatgatggcgagggtttcagcaataagtatgggtgttgtgatcatttgctgtctcggggattgttggtgagggttgaggcacccaggagggtggcgagggcgcatgcggcgataatggcgagggctgccttgtggggggtgccggttgcgtacatccatgtgatgatgccgccttggatccatgccagtgtggtgaagaaggtttcgtaactgtgcaactcgatactgttgggtgtgttcatgctcgctcctgaagaatggtgttgatggttttgtaaatgttgtacaggtcggtttcgatagataacagttggtggatttggtggtcgaggttgatatctgggttgagggtgttgatgcgggatgcgatgtcggtggctgtgcgtagtgtgccgccggtgtggtgaataatgtgtgcggtgtcggcgagtccggtggtgacagcatagtgggagaggagaggcatagcggggatgctccttggcgggttactgttgcgggttgatgttgaggtcggtgacgtgcgggtggtcttctgttcctgtgatgaggcagtggacggtgactgggagtttggatgcgccgggctgtttcatggttgcgccgtagacgatgctgaacgtgtctttaccgatggttttgtggagttggaggtcgatgtcggggttgccgttccagttgacgccgtgtgcggcggccttctgttcggctttacggttgcaggtgtgtgctgcggtgatcatggtgagaccctgcgcggtttcttcaccccttgcttgggcttgcttgtgggttttggcttgttcggcttgtagggagcgggtggcggctgcctgccgtgccgctttctcggctttgcgctgttgggcggtttttggtgtccattctgtgttggctgtggttacctgtggtgcgggttgtgatgcgagtggggggttgtcgtcgggggctgggaggaaggatgcggcggcgatgatggcggctgtgattccggcgatggtgtagccgtttttcttgttcatgactgttatcccctttccggggtgttgttcgttgctgacatgattgatacttccagacggggctatgactgtcaaggtgtcgctcagtttgtgtgagcgatccttgtgtggctgggggttatcgggcgaacagggtgagtaggtgtcctaagttgatgcgactcacgttccagtagagttgcgtggcttcaccgcccgtgagcggcttccacttgttgtggctgaacactgtaccgtcggatgctatgaacgtgtcggggcgtagcttgtgaagttcagtctctacgctctgccggtaggcttcggcgaggccctcaaaatccatgtggtcaccggagaggttttcgaggcgtgtcaggtcgaagggtgtggggcagtcgtagctggcgggggtgtagagctgggtgaagtggtcggcgatcttttgcatcatgattccttttctagtgtggtgggttaatagttttatcgggtggatgcgacaaggatggcgtctatgtcgatcatgtcgatgagatcgtggagttcctcggcctcattctcagataggtggcgccagtcgtagtcgccgtacacggcgccgtcgagggtgacagtccacaggggccggatgagccgtatggcttcttgtactttggcgtggtacatgcggcgcaccatatccagatcgatgtcgtctgaatggtttccggtgaggctgtggagactgagggggtcgatttctgtctgctggtagaggctggtgaaggatggggtgatgagtgtgccatccatgggggggggtgctcctttctggattgtttgggttggttgttgtggtttctaggatgtgtaggttgcgacccacagtcaaggctgcgctcaatccgaatgagcgtttagcgtgtgtggcatgggatgtggcgtatctcacttaagccttccttgcctctctaggcgtctcaaatcttctgggggtaggattatatagggttgaccctgctgatcgattctagagcccttctagggcctctcgggggtatgtctgagtgatgacgggtgtggcagatgatctagcgagtcaaggtgccgagcttagacataaaatctatcatctaggtgtgtgagatgtatcacatcctcctggcttggtgtgcactttcaaggctactctgtcgatctgacgtggagggtgtagcccagaaataccgtttaaagccactgggagacgcctagaagcgccttacggggtgggggctaggtatttatacccccagcatattctgatcgattctagacgcctacagaagcctggtacacgatcagctatccagacgcagaccatcagcccctatcccgcttagctaagcctgcactatgtggacattgttggatactgtagaggaaagaaggacacggtaaaggaaagagggggaatcagtcttagggtcttaggtacttcagttcaccttaggggcttagcgctgagcacttagcgctaagcccctcaagggctcggcatcagcctgacaggcttagcccatactgcacagccctgaaaggagtacacgccatcagggaaggcttgagagtacgaggagcctcagcgacgagtactcgaaagcctgagggaacacctttagcactgatgggcctagcgcgttcggaaagaacacagaagtaaagtgtgacagctgtccgggagtgaaccccgttctggctaggggtttcagtcttaactacctgtaaaggttacaagactctaagaaaatttaagaaaattcttaagaagaaagttgtgttgttatcccccaaaaaacacccgtttacacccctcaaacccgcctatagagccaaatccgccagtttgactcgtcccaggtggcgtatgctaggctggacaggtagccagctggacgcgaggccagaaagtgctgacgcacttcccgacctcgcttaccatcagtctaccaaacactttaaagcttcaaggctaagccactcagtgctaagcccttaagacctcaacgcttagcaccgagcccttgaggggctcagcattagcactaaggcttaaacacttaataatttaagtaaacataaaagcttttaagacttaaagtaaatatataaccttaacagttaaacgtttaaagctttaaaccttaacacctaagttaggtataaaaccttaaaggcttagcacttaaggatataaacttaacatcagtgtttaagactttaaaacttaaagtaactataagacttaaagacttataagctttaatacttatataataataaagtttaagactgatggttaactttaagtgtttaaagtcttatagttactttaagttttaaagcttataagttataaaagttttagaagagctaaggggttaacttctttacttctctactctctttggttctttctctcttctcttcttttcttcatcaggggagaagaggaacctttaccatcagcgctgatgggctttcacggtgtgtctcgtgtgtctctggtcgcaagctcccatcgcaccctcgccacccctcaccttgaccgtgtctcctttacagcttggtgtgttcggctgaaggcgtacggcgtgtcacgctaacacccttaacaccaggtaagacttaaagtgtatattatatgtagaagactttaaaaactttgaggatgtacacgttttggctgtgacctacaccgctaggcgctaggccttgaaacgcgaacacaccctcccccatttttcttccgtgtccttcttcttttgacacagctggggggcgatgtgatctttctcacatgcaggggtggagggtagaaaacaaccaccccaccacaaacagaacaccccaccaaacgaacaaaacagggcctagaatcgaccagcagggcaagggcaaggtattcatacccccaacgcatttcaggctgttacagaggcaatcagaggcttacagggaccataggtgaacgggaggcgcgatggcacacaccaaccgcaccgcatccgccgcccaccggcgctggcggcaacgactcatcacccaagcccgacaacaaggccaaaccgaatgtcccttgtgtggagccaccatcacctgggacacacacgacctaccaaccagccccgaagccgaccacatcacacctgtcagcaggggaggactcaacaccctcgacaacggccaaatcatctgcagaacatgcaacagaagcaaaggcaacagaacacaaccaaacattcgattccaacaacaaaccacaaaaacattgattccatggtgacaaaccccacaacccccaccggggacaccccctgcacacccgtgcaagacc

SEQ ID NO: 45 - DNA, 29443 bp, Unknown
  source: /note="Description of Unknown: Bacteriophage of P. acnes"
agtgaaatacctcccttttgtggatttatctgtttgtcgactttttgtgttggtggtgagtgttgtgcagcctgagcttcctgggtctcgtgattggtgtggggagacgcttcgctggtggcgtgtgtggggtgaggatagtcgcgcatcgtacgtgtcggatgaggagtggctgtttctcatggatgctgcggtgattcatgattgtgtgtggcgtgagggccgggctgaccttgtggcttcgcttcgtgctcatgtgaaggcttttatgggcatgttggatcgttattcggttgatgtggcgtctggtggccgtggtgggggttctgcggtggcgatgattgaccggtatcggaagcgcaagggggcctgattaggtgtctggtgttgttgggtctcaggtgcctcgtcaccgtgtggctgcggcgtattcggtgactgccggcggggatgctggggaattgggtcgtgcgtatgggttgatgcctgatccgtggcagcagcaggtgttggatgattggcttgctgtcggtggtaatggcaggcttgcttctggtgtgtgtggggtgtttgttccgcggcagaatggcaagaatgctattttggagattgtggagttgtttaaggcgactattcagggtcgccgtattttgcatacggctcacgagttgaagtcggctcgtaaggcgtttatgcgtttgaggtcgttttttgagaatgagcggcagtttcctgacttgtatcgtatggtgaagtcgattcgtgcgacgaatggtcaggaggctattgtgttgcatcatccggattgtgccacgtttgagcgtaagtgtggctgtccgggttggggttcggttgagtttgtggcccgttctcgtggttctgctcgcgggtttacggttgatgatttggtgtgtgatgaggctcaggagttgtcggatgagcagttggaggctttgcttcctaccgtgagcgctgcaccgtctggtgatcctcagcagattttccttggtaccccgccggggcctttggctgacggtagcgtggtgttgcgtcttcgcgggcaggctttgtcgggtggtaaaaggattgcgtggacggagttttcgattcctgacgagacggttccggatgatctatcgaggtcgtggcggaagttggctggggatacgaatcctgcgctgggtcgccgcctgaatttcgggacggtgagcgatgagcatgagtcgatgtcggctgccgggtttgctcgggagaggcttggctggtgggatcgtggccagtcggctacgtctgtgataccggccgataagtgggctcagtctgctgtggatgaggcgagtctggttggcgggaaagtgtttggtatctctttttcgcgatcaggcaatagggttgctttggctggtgccggcaggactgatgctggtgttcatgttgaggttattgatggcctgtcggggacgattgtggatggtgtaggccagctggctgactggttggcgttgcgttggggtgacacggaaaagatcatggttgccggttcgggtgctgtgttgttgcagaaggctttgactgatcgtggtgttccgggtcggggtgttgtggttgccgatactggggtgtatgtggaggcgtgtcaagcctttctggaaggcgtaaggtctgggagtgtttctcatcctcgtgctgattctcgccgtgacatgttggatattgctgtaaggtcggcggttcagaaacataaaggctctgcgtggggttggggttccacatttaaggacggttctgaggttcctttggaggctgtgtcgctggcgtattttggtgcgaaaacagttaaagcgaagcggcgtgagcgtagtggtaggaagcgggtgtctgtggtatgaactcggatgagttggctctgattgagggcatgtttgatcgtattaagagtttgtcttcgtggcattgtcgcattgagggctactatgagggttctagccgggtgcgtgatttgggggtagctattcccccggagttgcagcgtgtgcagactgtggtgtcgtggcctgggattgcggtggatgctttggaggagcgtctggattggctgggctggactaatggtgacggctacggcctggatggtgtgtatgctgcgaatcggcttgctacggcgtcgtgtgatgtgcatttggatgcgctgatttttggtttgtcgtttgtggctatcattcctcatggtgatggttcggtgtcggttcgtccgcagtcaccaaagaattgtactggccggttttctgccgatgggtctcgtctggatgctggccttgtggtgcagcagacgtgtgatcctgaggttgttgaggcggagttgttgcttcctgatgtgattgttcaggttgagcggcggggttcgcgtgaatgggttgaggtggatcgtataccgaatgtgttgggtgctgttccgcttgtgcctattgtgaatcgtcgccgtacttctaggattgatggccgttcggagattacgaggtctattagggcttacacggatgaggctgtgcgcacactgttggggcagtctgtgaatcgtgatttttatgcgtatcctcagcgttgggtgactggcgtgagcgcggatgagttttcgcagcctggctgggtcctgtcgatggcttctgtgtgggctgtcgataaggatgatgatggggacactccgaatgtggggtcgtttcctgtcaattcgcctacaccgtattcggatcagatgagactgttggcgcagttgacggctggtgaggcggctgttccggaacgctatttcgggtttatcacgtctaacccgcctagtggggaggctttggcggccgaggaatctcggcttgtgaagcgtgctgagcggcgccaaacgtcgtttggtcagggctggctgtcggttggtttcctggctgccaagtcgcttgattcttccgttaacgaagctgatttttttggtgatgttggtttgcgttggcgtgatgcatcaacacctactcgggcggctacagcggatgctgtgacgaagctggttggtgccggtattttgcctgctgattctcgcacggtgttggagatgctggggcttgatgatgtgcaggttgaggctgtgatgcggcatcgcgccgaatctgcggatccgttggctgcgcttgctggggctatttcccgtcaaacgaacgaggtttgatggatggcttcgggtgctatgtcgaggctggctgcgactgagtatcagcgtgaggcggtcaggtttgctgggaagtatgcgggctattattctgagcttggccgtttgtggcgtgccggcaggatgagtgacacacagtatgttcgtttgtgtgtggagttggagcgtgccggccatgatggttcggcgtcgttggccgccaggtttgtgtcggattttcggaagcttaacggtgtcgatcctggtttgattgtgtatgacgagtttgatgctgccgcggctttggctaggtcgttttcgactatgaagattatgaatagtgacccggatcgggcgaatgatacgattgatgcgatggcggcgggttttgatcgggctgtcatgaatgctggtcgtgacacggttgagtggtctgcgggtgcgcagggtaggtcgtggcgtcgtgtcacggatggggatccgtgtgctttttgtgccatgttggctacgaggtcggattatacgactaaggaaagggcgctcactactggtcatacgcggcgtcataagcgtggtggtaagcgtccgtttggttcgaagtatcatgatcattgtgggtgtacggtggttgaggttgttggcccttgggaaccgaatagggctgatgccgagtatcagaggacgtatgagaaggctcgcgagtgggttgatgatcatgggttgcagcagtcgcctggcaatattttgaaggctatgcgtactgttggtggcatgagataatttgatgtggtttccggttgtgcgccgccggttatcggtgcacagggttgtctcccgcacgggggtcaacaatgttgtgttgttttccgcaaggagtgtagggttaggctatggccgatcagagtgttgaggaacagaatgttgacaatgatgttgtggagtccggaaagggtgacggcattgttgacacggtgaagggcgatcaaggcaaacaggttgaagatcagtcgaagaatgaaggcgagggtaaatcgccggggactgattggaaggctgaggctcgtaaatgggagtctcgtgcgaaaagtaatttttccgagctggagaagcttcgtacatcgagtgacgattctggatctactattgatgagcttcgccgcaagaatgaggaactcgaagacaggatcaacgggtttgttcttgagggtgtgaagcgtgatgtggctgccgagtgtggcctttcgggtgatgctgtcgcttttctgcacggcgacgatcgtgaagcgctggtggagtctgctaaggctttgaagggtttgatcgaccatagtagtggtggcgcgggtgtgcgccgtcttgcggggagtgcccccgttgatgatgttaaacgacgtgagggtgtcgcgtttgtggatgctcttgtcaataattctaggagatgatttgtgatggctgacgattttctttctgcagggaagcttgagcttcctggttctatgattggtgcggttcgtgaccgtgctatcgattctggtgttttggcgaagctgtcgccggagcagccgactatttttggccctgtgaagggtgccgtgtttagtggtgttcctcgcgctaagattgttggtgagggtgaggttaagccttccgcgtctgttgatgtttcggcgtttactgcgcagcctatcaaggttgtgactcagcagcgtgtttcggacgagtttatgtgggctgatgctgattaccgtctgggtgttttgcaggatctgatttccccggctcttggtgcttcgattggtcgcgctgttgatctgattgctttccatggtattgatccggctacgggtaagcctgctgcggctgtgaagacttcgctggataagacgaagcatgttgttgatgccacggattctgccacgactgatctggtcaaggcggtcggcctgattgctggtgctggtttgcaggttcctaacggtgtcgccctggatccggcgttctcgtttgctctgtcgactgaggtgtatccgaaggggtctccgcttgccggtcagccgatgtatcctgccgccgggttcgctggtttggataattggcgcggcctgaatgttggtgcttcttcgactgtttcgggtgccccggagatgtcgcctgcctctggtgtgaaggctattgttggtgatttctctcgtgtccattgggggttccagcgtaacttcccgatcgagctgatcgagtatggtgacccggatcagactggccgcgaccttaagggccacaatgaggttatggttcgcgccgaggctgtcctgtatgtggctatcgagtcgcttgactcgtttgctgttgtgaaggagaaggcttccccgaagcctaatccgccggccgagaactgatttatttgttgcgataatgttcatgctgtgtgcagggggtggtgttgatgggtatcattttgaggcctgaggatattgagcctttcgccgatattcctaaagataagcttgaggcgatgattgccgatgtggaggctgttgctgtcagtgtcgccccctgtatcgctaaaccggatttcaaatacaaggatgctgctaaggctatcctacgtagggctttgctgcgctggaatgatactggtgtttctgggcaggttcagtatgagtctgcgggcccgtttgctcagactacacggtctagtactcccacgaacttgttgtggccttccgagattgccgcgttgaagaagctgtgtgagggtgatggtggggctggtaaagcgttcactatcacaccgaccatgaggagtagtgtgaatcattctgaggtgtgttccacggtgtggggtgagggttgctcgtgcgggtcgaatattaacggctacgctggccctttgtgggagatatgatatgaccagttttccttacggtgaaacggttgtgatgcttcagccgactgttcgtgtcgatgatttgggcgacaaggttgaggattggggtcatcctgtagaaaccgtgtaccataacgtggctatctatgcttccgtttcgcaggaggatgaggccgcggggcgtgattctgattatgagcattggtcgatgcttttcaagcagcctgttgtgggcgctgattatcgttgtaggtggcgtattcggggtgtggtgtgggaggctgacgggtctcctattgtgtggcatcacccaatgtctggctgggatgctggtacgcaggttaatgtgaagcgtaagaagggctgatggttgtggcacgtgatgtgaatgtgaagcttaatcttcctggtatccgtgaggtgttgaagtcttctggggtgcagggcatgttggcggagcgtggcgagcgtgtcaagcatgcggcctctgctaatgttggcggtaatgcttttgatagggcccagtatcgtgccgggttgtcgtcggaggtgcaggttcaccgtgttgaggctgtcgctaggattggcaccacctataagggtggtaagcgtattgaggcgaagcatggcacgttggctaggtcgattggggctgcgtcgtgatcgtttacggtgatccgcgaatatgggcgaaacgcgtgctcaaggatgatggctggctgtccgatataccgtgtacaggtactgtcccggatgatttcacgggtgacttgatttggttggcgttggatggtggcccgcagttgcatgttcgtgagcgtgtttttttgcgggtgaatgtgttttctgatatgccggatcgtgctatgtctttggcgcgtcgtgttgaggctgtgctggctgatggtgttgatggtgatccggtggtgttttgtaggcgttctactggtcctgatttgttggttgatggtgcacgttttgatgtgtattcgctgtttgagctggtgtgccgtcctgtcgaatccgagtaaacgtatttgttttctatattttgtttttgtttgattatttttgggggttgtgatggctgctacacgtaaagcgtctaatgttcgctctgctgttacgggtgacgtctatattggtaaagctcatgccggtgacactattgatggtgtgaagacggttcctgacggtcttaccgctttagggtatctgtctgatgacgggtttaagattaagccggagcgtaaaacggatgatttgaaggcttggcagaatgcggatgttgttcgcactgtggctacggagtcgtctatcgagatttctttccagctgatcgagtctaagaaggaggttatcgaactgttttggcagtcgaaggttactgccggagccgattcgggttcgttcgatatttctcctggtgccacgacgggtgttcatgccctgttgatggatattattgatggcgatcaggttattcgctactatttccctgaggttgagttgattgatcgtgacgagattaagggtaagaatggcgaggtgtacgggtatggtgtgacgttgaaggcgtatcctgcccagattaataagaatggtgatgcggtgtcgggtcgggggtggatgacggctttaaaagctgatactcctccgactcctcctccggccccgaagcctccgaagcctgagccggatccgaatccgccgtctaataactgatacacatagtttgagggattgttgatagatgagtgacacaggttacacgttgaagattggtgaccgtagctgggtgttggcggatgcggaggaaacggcgcaggctgttcctgcccgcgttttccgtcgtgccgccaggattgcccagtcgggggagtctgcggatttcgcccaggttgaggtgatgttttctatgttggaggctgccgccccagaggatgctgtggaggccttggaggggcttcctatggttcgtgtggccgagattttccgccagtggatggaatataagcctgaaggtaagggtgcctcgctgggggaatagtttggctccacggcctgattgatgattatcgtggggccatcgaatacgatttccgcactaaatttggtgtttctgtttatagtgttggtggcccgcagatgtgttggggtgaggctgtccggctggctggcgtgttgtgtaccgatacgtctagccagttggcggcccacctgaatggttggcagcgcccgtttgagtggtgtgagtgggctgtgctggacatgttggatcattacaggtctgctaatagtgaggggcagccggagcctgtggcgaggcctacggatgagcgtagggcccggtttacgtctgggcaggtggacgatattttggcgcgtgttcgtgccggcggcggggtgtctcgcgagattaatattatggggtgaatagtgtatgtctggtgagattgcttccgcatatgtgtcgttgtatacgaagatgcctggccttaaaagtgatgttggtaaacagctttctggggttatgcctgctgagggtcagcgttcgggtagtctttttgctaagggcatgaagttggctcttggtggcgccgcaatggtgggtgctatcaatgttgctaagaagggcctcaagtcgatttatgatgtgactattggtggcggtatagctagggcgatggctatcgatgaggctcaggctaaactgactggtttgggtcatacgtcttctgacacgtcttcgattatgaattcggctattgaggctgtgactggtacgtcgtatgcgttgggtgatgcggcttctactgctgccgcgttgtctgcttcgggtgtgcagtctggcgggcagatgacggatgtgttgaagactatcgccgatgtgtcttatatttcgggtaagtcgtttcaggatacgggcgctatttttacgtctgtgatggctcgcggtaagttgcagggcgatgacatgttgcagcttacgatggcgggtgttcctgtgctgtctttgcttgccaggcagacgggtaaaacctcggctgaggtgtcgcagatggtgtcgaaggggcagattgattttaacacgtttgcggctgcgatgaagcttggcatgggtggtgctgcgcaggcgtctggtaagacgtttgagggcgctatgaagaatgttaagggcgccttgggctatcttggtgctacggctatggccccgtttcttaacgggttgaggcagatttttgttgcgttgaatccggttattaagtcggtcacggattcggtgaagccgatgtttgctgccgtcgatgctggtattcagcgtatgatgccgtctattttggcgtggattaatcgtatgccgggcatgattacgagaatgaatgcacagatgcgcgccaaggtggagcagctgaagagcgtttttgcgagaatgcatttgcctgtcccgaaggtgaatttgggtgccatgtttgcgggtggcacagcagtgtttggtgttgtggctgcgggtgtggggaagcttgttgcagggtttgccccgttggcggtgtcgttgaagaatcttctgccgtcgtttggtgctttgaagggtgccgctggcgggcttggcggcgtgtttcgcgccctgggcggccctgtcggtattgtgatcggcttgtttgctgccatgtttgcgacgaacgcccagttccgtgccgcggtgatgcagcttgtggctgtggtgggccaggctttggggcagattatggccgctattcagcccttgtttggtttagtggccggtgttgtggcacagttggcgccagtgttcggccagattatcggtatggttgccggtttggctgcccagattgtgcctttgattagtatgcttgtcgcccggctggttcctgtgattacgcagattattggtgcggtgactcaggttgctgcaatgttgttgccggcgttgatgccggtgcttcaggcggttgtggctgtgatacggcaggttgttggtgttgtgatgcagcttgtgcctgtgttgatgcctgtgattcaacagattttgggtgctgtgatgtctgtgttgccgccgattattggtttgatacggtcgctgataccggtcatcatgtctgttatgcgcgtagtggtgcaggttgtttcggttgtgttgcaggtggttgcccgtattattccggttgtgatgccgattgttacggctgtgatcgggtttgttgcacgtattttgggtgctattgtgtcggctgccgccaggattattggggctgttgcccgtgttgtcggatgggttgtgggccatttcgtgtcgggtttggcgcgtatgggttcggttattcaggctggctggaatcatattagggcttttacgtctgcgtttattaacggtttcaagtcgatcatttctggcggcgtgaacgcggttgtcgggttttttacgcggcttggtttgtcggttgcctcccatgtgaggtctggttttaacgcggcacgtggtgctgtttcttctgcgatgaatgctatccgtagtgtggtgtcttcggtggcgtctgctgttggcgggtttttcgggtcgatggcgtctagggttcggaatggtgctgtgcgcgggtttaacggggcacggagtgcggcctcttctgctatgcatgctatggggtctgccgtgtctaacggtgtgcatagtgtactgggttttttccggaatctgcctggcaatattcggcatgctctcggcaatatggggtccctgttggtgtctgctggccgtgacgtggtgtctggtttgggtaatggtattcggaatgctttgagtggcctgctggatactgtgcgtaatatgggttcccaggtggctaacgctgcgaagtctgtgttgggtattcattccccgtcgagggtgtttcgtgatcaggttggccgtcaggttgttgccggtttggctgaggggatcaccgggaatgctggtttggcgttggatgcgatgtcgggtgttgcttcgcagcttccggatgctgtggatgcccggtttggtgtgcgatcgtctgtgggctcgtttaccccgtacgaccggtatcggcgtgctcagggtgagagtgttgtggtgaatgtgaatggcccgacgtatggtgatcctgccgagtttgcgaagcggattgagcgtcagcagcgtgacgctttgaacgcgttggcttatatgtgagtaaaggggtatgcatgtttattcctgacccgtctgatcgttctggtttgactgtgacatggtctatggatccgcggtttggtgatgagcgtgtgcttcatttgacggattatacggggtcgtctccggtgatgttgttgaatgattcgttgcgcggtttgggtgttcctgaggttgagcatttttctcaaactcatgttggggtgcacgggtcggagtggcgcgggtttaatgtgaagcctcgcgaggtgacgttgccggtgttggtgtcgggtgttgacccggatccggtgggcgggtttcgtgacggttttttgaaagcctatgacgagttgtggtctgcgtttcctcctggcgaggagggggagctgtctgtgaagactcctgccggtgtagagcgtgtgttgaagtgccggtttgattcggtggatgacacgtttacggttgatccggttaatcgtggctatgcgcgttatgtgcttcatttgacggcctatgacccgttttggtatggggatgagcaaaagtttcgtttcagtaacgcaaagttgcaggattggttgggtggcggccctgtcggcaaaaacgggactgcttttccggtggtgttgacgcctggtgttggttcgggttgggataacctgtcgaataagggtgatgtgcctgcgtggcctgtgattcgcgttgaggggccgttggattcgtggtcggtgcagattgatggtttgcgtgtgtcttcggactatcctgtcgaggagtttgattggatcactattgatacggatcctcgtaagcagtctgcgttgttgaacgggtttgaggatgtgatggatcgcctggatgagtgggagtttgcgccgattccgcctggcggttctaagagtgtgaatattgagatggttggtttgggtgccattgttgtgtcggtgcagtacaggtttttgagggcgtggtgaattgttgtggctggtcttgtcccgcagataacattgtttacgccagactatcatcgtgtggcgcctatcaatttttttgagtcgctaaaattgtcgttgaagtggaatggtttgtcgacgctggagttggtggtgtctggtgatcattcgaggcttgacgggttgacgaggccgggtgcacgcctggttgttgattatggtggtggccagattttttctgggcctgtgcgtaaagtgcacggggttgggcctcggcggtcttcccgtgtgactatcacttgtgaggatgatattcgcctgttgtggcgtatgttgatgtggcctgttaattatcgccccggtatggtgggttctgagtggcgtgcagaccgggattatgcccactattctggtgcagccgagtctattgctaagcaggtgttgggggataatgcttggcgttttccgcctggtttgttcatgatagaggatgagaagcgtggccgctatattaaggattttcaggtgcggtttcacgtgtttgcggacaagttgttgcctgtcctgtcgtgggctcggatgactgtttcggtgaaccagtttgagaatgcgaagacggatcagcgggggctggtgtttgattgtgttcctgctgtgacgcgtagccatgtgttgacgtccgagtcgggttcgattgtgtcgtgggagtatgtgagggatgcccccaaggctacgtcggtggttgttggtggccgcggcgagggtcgggatcggctgttttgtgaggatgttgattcgatggccgagggggactggtttgatcgtgtcgaggtgtttaaggatgcccgtaacacggattctgaacatgtgcatctcatcgatgaggctgagcaggtgttgtccgagttaggggccacgtcggggtttaagatcgagttggccgagtcggatgtgttgcgttttgggccaggcaatctgatgccaggggatttgatttatgtggatgtgggctcggggcctattgaggagattgttcggcagattgatgtggagtgtgattcgccgggtgacggctggacgaaagtgacaccggttgcgggggattatgaggataatccgtcggcgttgttggctcgccgtgtggctggtttggctgcgggtgtgcgggatttgcaaaaattctaattgttgggggtttgttgtgggtattgtgtgtaaagggtttgatggtgtgttgaccgagtatgattgggctcaaatgtctggtctgatgggtaatatgccgtcagttcatgggcctgacgattttcgtgtgggcactactgttcagggtgctacggtgttgtgtgaggttttgccggggcaggcttgggctcacggggtgatgtgcacgtcgaatagtgttgagacggtgacggggcagctgcctggtcctggtgagactcgctacgattatgtggtgttgtctcgggattgggagcagaatacggccaagttggagattgttcctggggggcgtgcggagcgtgccagggatgtgttgcgtgccgagcctggcgtgtttcatcagcagttgttggctactttggtgttgtcgtctaacgggttgcagcagcagttggataggcgtgccgtggcggctagggttgcgtttggggagtctgctgcgtgtgatcctacccctgtggagggtgaccgtgtgatggttccttcgggggctgtgtgggctaaccatgctaacgagtggatgttgttgtctcccaggattgagacgggttcgaagtcgatcatgtttggcgggtctgctgtgtatgcttacacaattccgtttgagcgcccgtttggtagtgcgcctgttgtggtggcgtctatggctacggcggctggtggtacgcagcagattgatgtgaaagcctacaatgtgactgccaaggattttggtttggcgtttattacgaatgatggttcgaagcctaacgatgtgcccgcaatagctaactggattgctgtcggcgtgtgactgtacaggtgttgtggcggatgttgtaatgttggggggctgtggtgtcgtggtttactcctgcactggtggcctctatctgtaccgcgttggccacgattttgggttcagttcaggcggtcacatctaaatcgaggaagcgtttacgcaggctatctgcgcaggttgatgcgatggaagagtatacgtggggtgtgcggcgtgaggtgcgccggtttaacgcgaggcttcctgacggggttgatccgcttgtgttgcctgagccgcctggtttcctatcggatgatgttgggggtgagtgatgagggagttggaggaggagaagcggcagcgtcgctcgtttgagagggcttccctgctgttgttgtttttgtcgcttgtgctgttgattgtggttgctgggggtgctttgcgtttcggggctgtatcctctgaacgggattctgagcaggcgagggcccagtcgaatggtacagcggccaggggtttagccagccgtgtgcggcaggtgtgtgcccatggtgggatggagtcggtacggcttcaccggtctggtttgtgtgtggatgctgtgcgtacggagcggagtgttcagggtgtgccgggcccggctggtgagcgcggcccgcaaggccctgcaggtgctgatgggcgtgacggtgttaatggttcgtctgggctggttggccctgttggtccgcagggttctcccggcttgaatggcgtgaaaggtcctgacgggttgcctggtgcaaatggatcggatggccgtgatggtgttccgggccgtgcaggtgttgacggcgctgatggtcgggatggttcggctggtgagcgcggtgatgtgggtccttcaggtcctgccggcccgcaaggcacacagggggaacggggtgagcgtggccccgtcggtgcgaacggatccgatggtaaagatggtaaggatgggcgctcggtggtgtctgtgtactgttctgatggtctcctggttgtgaaatatagtgacggtgtggcttctacaatatcgggctcggtggcctgccagggtgtgaaaccgtcgcctatggtgactatatcatcccacaaatagaaaggagtggctgtgatggtagtgtttggtggtggtgtgtggtgaggtttatcccagcagcgcaccattctgccggttcgaatagtccggtgaatagggttgtgattcatgcgacgtgcccggatgtggggtttccgtccgcctcacgtagggggagggctgtttctacggcaaactattttgcttccccatcgtctgggggttctgcccattatgtgtgcgatattagtgagacggtgcaatgtctgtctgagtctacgattggttggcatgccccgcctaaccctcatagtttgggtatagagatttgcgcggatggtggctcgcacgcctcgttcagggtgccggggcatgcttacactcgtgagcagtggcttgaccctcgcgtgtggcccgcggtggagcgtgccgcgatcctgtgtagacgtttgtgtgacaaatataatgttccgaaaaggaagcttagtgcagccgatttgaaggctggcaggcggggtgtttgcggccacgtggatgttacggatgcgtggcatcagtcggatcatgacgatcctgggccgtggtttccgtgggacaaatttatggccgtagtctgcggcggtagtggtagtgaggagttaactgtggctgatgtgaaagccttgcatgatcagattaaacaattgtctgcccagcttactggttcggtgaataagctgcaccatgatgttggtgtggtacaggtacagaatggtgatttgggtaaacgtgttgatgccttgtcgtgggtgaagaatccggtgacggggaagttgtggcgcacgaaggatgctttgtggagtgtctggtattacgtgttggagtgtcgcagccgcattgacaggcttgagtctactgttaacggtttgaaaaagtgatggtggtttgttgtgggtaaacagttttggttaggtttactggagcgggccctgaaaacttttattcaaacgtttgttgccgtgctcggtgttactgcgggtgtcacgtatactgcggagtcgtttcgcggtttgccgtgggagtcggcgttgatcacagccacggttgctgcggtgttgtcggttgctacttcgtttggtaatccgacgtttgtggctggtaagccgaagactacggttgtggataccgggcttgttccacccgatgataccggtttgatagaaccgcatgcggtggatgtgtcggatcctggcatgattgagccgatggatgatgcggatgttgccggctatgtgccgaagcgggctgccgagtcggaggttggcacagtagagtctactgttgcataattgaatatgtgtgtgccccagcggtgctgccacgattgtgtggtggttgccgctggggcacactttttgtttatgcgatatggctatgattcgttgctgtcgatggtgtcttcgagcatctgatacaggtggaggcaggtgcagatggtttcgctggcctggtcgagaacgtttcggccgataacgtttttgtggttgtcgcggtggcggatgatagcccacatgatctcgtcggctgccgcctgtaatagttttgcctggtatgcgattccggcgagccagtctagtgcttcctggcttgcctgtgtgtcgtctggaataccacgggtgttgctgttgcttgggtgtccttcactgtcgcatagccacaggatttcgctgcactcgtctagcgtgtcctggtcgatagcgagatcgtcgaggctgacattgttgacggtaaggttcacgttgtcgagggagatgggtacaccgtactggttttcgacactgtcaacaatgttttgtagttgttgcatgttggtgggctgttgttggatgatacggtgtaccgctgctttgagggcagtgtaggggatattgtgtgtgttgttcatggttttatttcatccctgtgctgtcgtcgttatcgtctggatagtatctactgtttgcgtaccctgttagggtgatcaatgtttggtctgcccactgtttcacggtttgccgggttacccctaatcgttgggctgctaccgaataggtttgatcatacccgtatacttcccggaatgctgccaaccgtgctaggtgttttcgctgtttggatggctggcaggtgagggtgtagtcgtcgatggccagctggaggtcgatcatggagacgatgttgttgccgtgatgctggggggcggttggtgggggtggcataccgggttctactgatggtttccatgggccgccgttccagatccattgggcggcttggataatatctgcggtggtgtaagtccggttcactggtcaccccctgaacaggttgtcgaggttgtctgggttactggtgttggtggtgtcgaatcgtcccacacagtggcagtagtcgtacatgagtttgataatgtgttggtggtcgccgaggtaggtgttgccactaatactgtaggtggctgtgccgtctttgccgataatgtatttggcggtgatggtttctggtgtttcggtgttggtgatgattgctgttgtggtggtgcctacggtttgtagcctggtggtttgggttccgtcgtcgagggtggtggtaaccataattggggttttccttaaatgcttgtctggttgtcggctagatgaataatatcggataaaggtttcggctggtctaggtgctgtaccgctttgttggctaaacgtttggctaccctgtaacacattttggtatagtgtttgttgtctaggttgtggtattgttcccgcaccgcaatatatagtagggagtcttggtacaggtcgtctgcactgattgcggggtagtgggtggctactttgatgcatgaccggttgagtgtgcgaagatgatggtcggtggtccatccccacgatgcggtggtggcccggtctgcttttgttggtcgtctactcatggcactatttcatctcgctatctggtagttgtttggtgttttatggttgatagtgtagcacacgagtccggggttgccggtggtgcccgtcttgtgccggtaccatgtggattcgccttccatggatgggcattggatgaaggtgcgttgtccttgctcggagatttctaggtggtgtcggtgcccggccatgaggatgtgggatgtggttccgttgtggaattcttgtccgcgccaccaatcatagtgtttgccggtgcgccattggtgtccgtgggcgtgcaggatttgtgtgcctgccacattgacggtggtggtcatttcgtctcggctggggaagtggaagtgtaggttggggtattggttgttgagttggtaggcttcggcgatggcgcggcagcagtccacgtcgaaggagtcgtcgtaggtggtgacgcctttgccgaagcgcacggcttcaccgtggttgccggggatggatgtgaccgttaggttggcgcagtggtcgaattggtggatgagttgcatcatggccatgcgggtgagccggatttgttcggtgaggggtgtttgtgtgcgccaggcgttgttgcctccttgtgacacgtatccttcgatcatgtcgccgaggaatgcgatgtggactcgttgcggtttgcctgcctgttgccagtagtgttttgcgactatgagggagtgcaaatagtcgtcggcgaagtgtgctgtttctcctccggggatgcctttgccgatttggaagtctcctgccccgatgacgaaggccgcagtgctgtagtcggtgcgggtgtcttgttcgggttttggtggctgccattcggctagtttatctacgagttcgtctacagggtaggggtttgttgcgggttggtggtcgatgattttttgtacggatcggccggtttctccgttcggtaaggtccattcggagatgcgtgtgcggcgtacagtaccattggctagattgtcgtcgatggtgtcgatggcgttgtcgtggttggctagctgtgtgagtagccggtctatattgtctatcactgggtatcctcttcctcgtgtggggtggtgttggcttgtttgcggcgatagtctttaataacggtggcggagatggggtatccggcttgggtgagctgttttgctagccatgaggcggggatggttttgtcggcgaggacgtctgcggctttgttgccgtagcgttggataagggtttcagttttggttgccatgatatcctaggggttgtgtggcgggttgccatcctgtgcggcagtcgccgtcgtgtcctggcttacgggtgcaccatgtgatggttccgtctgtgtggtggagttttttgccgcacatgacgttttgtagatgctccggcagctggtcggtgttgttgctggtttgtatgtcgaagagtgttttctggttggtgaaatgctctgacacggtgccattatgcacgggtagtatccatgttttccattgctgttgtagcctggtgttccagtggaattgtttggcggcgttttcggcctgttttaaggttttgtagtagccgactagtatgcgctggtgttcactgtcgggtgggttttggcctcgccaatattgtgccgccacggcgtagcggttgctggctgtgaaggcgtcccagcagtattcgataatgtgttgtagtgcactatcgggcatgtcttgtatttggttttcgttaagccattcttcaacaaggatgttgtgtatggcgcgtttgtctttgatggttggtttgaacgagatgctcacgatagtaccggctggtcgtcttgcatgaactggttgaaggtgttgtttccggcgtgttgggcttgtgtgatgtcctggtcggtccagtcggggtgttgctgtttcagatagtgccagtggcacgcattgtaggtttcgtcttgtagccgtgtgagatggttttcggtgatgatttgtttccacattgtccatgacacgtcgagccggttgaggatttcgagggctgggatgttaaattggttgaggaagagtatttcgtgggtgtagtagtttttctcgtaggcgtcccatccgcttcggtgcctgttgggctggtttttggggtaggcttcccggcatactttgtgcaaatgtttggccatgtcgtcgggtagtttaatgtcggggttggcgcggatcatggatcgcataccatcataggtggtgccccaggtgtgcataatgtaggtggggttttctccatcagcccatttttctgcacagatggcgaggcggatgcgcctcctggctgcttggctaatgttgcgccggttggggatggggcacgtgtctaggggatccatgatgttttagtgtacctttctttgttggggttgcttgtgtggttttattgtagcactgtgttgagtgcttgtgtcaaccctgttttgccggcctgaaggtaggtgtctgtgacatcccccagggtgaggggcacgtgtacggcttgggggagtgctgtttggagggtttgggccatcttgtctcccgcggggtcgggatcggaccagatgtaaacatggtcgtagccttcgaagaatttggtccaaaagttttgccacgaggttgcgccgggtatggcgacggccgaccatccgcattgttcgaggatcatggagtcgaattcgccttcgcaaatgtgcatttcggctgccgggttggccatggcggccatgttgtagatggagcccgtgtctccggccggggttaagtatttggggtggttgtgttctttgcagtcgtgtgggagtgagcagcggaaacgcatttttcttatttcggctggccgcccccaaacggggtacatgtaggggatggtgatgcactggttgtagtcttcgtggcctgggatggggtcattgtcgatgtatccaaggtggtggtagcgggctgtttcttcgctgatgcctcttgctgagagaaggtcgagaatgttttcgaggtgggtttcgtagagggccgaggctttctggattcggcggcgttccgcaatgttgtatgggcgtatgctgtcgtacattcgggtttctttcttcgagttgttgttgtagtttggcgaggccgcctccgacaccgcatgtgtggcagtaccagacgcccttgtcgaggttgatgctcatggagggttggtggtcgtcgtggaacgggcagaggatgtgttgctcgttcctggacgggttgtagcgtatccggtaggtgtcgaggaggcggcaggtgtcagaggtgtgggaggagttctgcgagggttgataccacataggcttcgctccatggcttgttgcgctgtttcatgaccactaacccgattgtggatttgtcaaccaggttgcggtgggtttcatagttgcgcgcctcccggctggcttgtttcacgaattgggcgagatgttgctgtcctgctttcgcttcgatcacataggttttgtggccggttgtgaggatgaggtcgccttcgtcttcgtggccgttgaggtgtagccgttcgatgtcgtgtccgatgtcacgtagctggtgcaataatcgtgtttcccactcggcaccggcccggcggttgcgtgattgctgtgtagccatcataatcctttgtgtgttgtggccatgttccatggctgtttttcggctagtggtccgaagaatgtgtattcggggtaggctcgtagccgttcgtatcgggtgccgtctgggctggatttgcctgtgcgctgtttcaacactgcgatgcgcgcctctgccggtatcgatagcccgttgccgttatcctcgccaccatacaatgagactccgaggatgagttgtggtttctcggatagcccgtttttgatctctcgtctggcgggcgggtgttcgatgtcggagccggttttgtcggttgcgtggtgtgtgacgataatggtggagccagtatccctacctaatgctgtgatccattgcatggcttcttgctgtgcctggtagtcactctcgcagtcttggatgtccatcaggttgtcgataacaatgagtggtgggaaggtgttccacatttccatgtaggcttgcagctccatggtgatgtctgtccatgtgatgggtgactggaatgagaatgtgatgtgttggccgtggtggatgctgcctcgatagtattctggcccgtagtcgtcgatgttgtgttgtatttgggcggttgtgtgttgggtgttgagggatatgattcgtgtggaggcctcccagggtgtcatgtcccctgaaatatatagggcgggctggttgagcatcgcggtgatgaacattgctagcccggatttttggctgccggaccgccccgcaatcatgacgagatcccctttgtggatgtgcatgtcttggttgcggtagaggggttctagttgtggtatacggggcagctcagcagcggtttgggaggctctctcgaaggatcgttgtagagagagcatcgggaccttaatctatctatctgttacggtttggatgaatattggcggtcagatggagtcgatatctacatcatcgctgccggtggtgttgggctggctgtctcgctggtcaacgtaggcggctacaaggtcgtagatggcgtcgtctaggggtttgaggatgacagcgttgaacccgtttttagtgcgcactgtggcgagtttgaaggcctgctcctcgccgaggtaggtttcgagttcgcggatcatggagtgtgggcggtcgttgttgcctcgcgctttttcgatgatagcgttggggatggtttctggggtgccgttgttgaggtcgtcgagggtgtggaagatagtaacgtcggcgtaaatacggtctgcgacctgtccgccgtagccttcggtgttgtgttccacgtcgtggattttgaaggcgatggcggtggcgtcctggtttttggacgggttgaagaaggtgctgctgttgctgttgttgcggtagttggcgagtcccataacttttgtccttttgctgtttgtgttgttttgttgtcttatattggtttatcgggtgaggctgtttcgtttagtgcggaacgcctcagacacgtcactgttactggtgatgatctttttgtactgtttcaagaggtctgctaattgtgctttactggtggctttgttgatcctgtcgatgataatgtcgttttcttgattggcgattttgttgacgtagtctttggctgctttgtcgtatcggtcttggaggatgatggatgcgctcgctacgagcgttgccagatcccagtctttggagactgtttcgtctttgagtccgcctagcaggtcgatgatggcctgttttgtctgctctgctgtgtctcctcggatgaccgcccatggtgcagcatagtctccaccatatttgagtgtgatagtgagtcgatcattgtctgtggtgcgctcttctgtcacttgttttccttttctttattgtctgcttggggtggctgtacggtggattctaccgggtatctgtaggcgtctttcccgtctaccgcccagcaggcgtcctgtacggggcatcctttacagagtgctgtaacatgtgggacgaagatgcctttgctgattcctttcattgcttgactgtacatggatgatacatgccggtaggtattgttgtcaagatcgtacagttcggttgctgtgccctgagtttgcgatgtggtgttgtttcggctgctggcgggtgtccaaaacatgcctttcgtcacgttgatgtcgtgttggttgagcatgtaccggtaggtgtgcaactgcatggcatcaacagggaggcgacccgttttgaggtcgagaataaacgtctcaccagtgtcggtgtcggtgaagatacggtcgatgtagccaacaatctttgtgccgtcctggagggtggtttcgactgggtattcgatgcctggctggccgtcgagtattgctgtgtggtattgtggatagtttgtgcgccactgtttccacctgtcgacgaagatggggccatagatcatccaccagtcgtagtctttcttgtgtggcccgcctgactcgcacatgtttttgcacactctgccggagggtttgatttctgtgccttcggattcgacgagggcaacttgggtgtcgaaaacgtttttgaaggatgagagtttgtctggcagtgcagggtattcgtcggggttgtacaggtggaggtcgtactgttcggtgatgtggtgtatggcgcttccggcgatggttgcgtaccaggtgtggtgctgtgcatgatagccgtgggataggcgccatttttctccgcattcggcccactgggtgagtgaactgtaggagatgtggcctggatggttgatggttttcggatattgtgctagaggcattacttgtcgcttttgttccatgggttgcgggtgtcttggccggcattgtgttgctggtaggcgaggagtgctaggcagtgccaggctgcgtgtgccaggtgtggcaggtgtgattcatcgtcgaggttgtttccttgctgccaggatagcacatggcggtagagggcgtcgacactgtgacaccaggggtatcctccggtccagttgttgtcgccgtatttggtggcaccgtagcctgctacttcgcctagggcgtgcaaggctacggggtcaatgagggagagcctgcagagtttgagttcttttcgggcacctgtgtcggggtcggtgtacatgcgggtgggctcatccatggggggtgtgtgcctttcttggtttgggttactggttgttgtcgtgggctagtgctactgcgagaataatgatggcgagggtttcagcaataagtatgggtgttgtgatcatttgctgtctcggggattgttggtgagggttgaggcacccaggagggtggcgagggcgcatgcggcgataatggcgagggctgccttgtggggggtgccggttgcgtacatccatgtgatgatgccgccttggatccatgccagtgtggtgaagaaggtttcgtaactgtgcaactcgatactgttgggtgtgttcatgctcgctcctgaagaatggtgttgatggttttgtaaatgttgtacaggtcggtttcgatagataacagttggtggatttggtggtcgaggttgatatctgggttgagggtgttgatgcgggatgcgatgtcggtggctgtgcgtagtgtgccgccggtgtggtgaataatgtgtgcggtgtcggcgagtccggtggtgacagcatagtgggagaggagaggcatagcggggatgctccttggcgggttactgttgcgggttgatgttgaggtcggtgacgtgcgggtggtcttctgttcctgtgatgaggcagtggacggtgactgggagtttggatgcgccgggctgtttcatggttgcgccgtagacgatgctgaacgtgtctttaccgatggttttgtggagttggaggtcgatgtcggggttgccgttccagttgacgccgtgtgcggcggccttctgttcggctttacggttgcaggtgtgtgctgcggtgatcatggtgagaccctgcgcggtttcttcaccccttgcttgggcttgcttgtgggttttggcttgttcggcttgtagggagcgggtggcggctgcctgccgtgccgctttctcggctttgcgctgttgggcggtttttggtgtccattctgtgttggctgtggttacctgtggtgcgggttgtgatgcgagtggggggttgtcgtcgggggctgggaggaaggatgcggcggcgatgatggcggctgtgattccggcgatggtgtagccgtttttcttgttcatgactgttatcccctttccggggtgttgttcgttgctgacatgattgatacttccagacggggctatgactgtcaaggtgtcgctcagtttgtgtgagcgatccttgtgtggctgggggttatcgggcgaacagggtgagtaggtgtcctaagttgatgcgactcacgttccagtagagttgcgtggcttcaccgccagtgagcggcttccacttgttgtggctgaacactgtaccgtcggatgctatgaacgtgtcggggcgtagcttgtgaagttcagtctctacgctctgccggtaggcttcggcgaggccctcaaaatccatgtggtcaccggagaggttttcgaggcgtgtcaggtcgaagggtgtggggcagtcgtagctggcgggggtgtagagctgggtgaagtggtcggcgatcttttgcatcatgattccttttctagtgtggtgggttaatagttttatcgggtggatgcgacaaggatggcgtctatgtcgatcatgtcgatgagatcgtggagttcctcggcctcattctcagataggtggcgccagtcgtagtcgccgtacacggcgccgtcgagggtgacagtccacaggggccggatgagccgtatggcttcttgtactttggcgtggtacatgcggcgcaccatatccagatcgatgtcgtctgaatggtttccggtgaggctgtggagactgagggggtcgatttctgtctgctggtagaggctggtgaaggatggggtgatgagtgtgccatccatgggggggtgctcctttctggattgtttgggttggttgttgtggtttctaggatgtgtaggttgcgacccacagtcaaggctgcgctcaatccgaatgagcgtttagcgtgtgtggcatgggatgtggcgtatctcacttaagccttccttgcctctctaggcgtctcaaatcttctgggggtaggattatatagggttgaccctgctgatcgattctagagcccttctagggcctctcgggggtatgtctgagtgatgacgggtgtggcagatgatctagcgagtcaaggtgccgagcttagacataaaatctatcatctaggtgtgtgagatgtatcacatcctcctggcttggtgtgcactttcaaggctactctgtcgatctgacgtggagggtgtagcccagaaataccgtttaaagccactgggagacgcctagaagcgccttacggggtgggggctaggtatttatacccccagcatattctgatcgattctagacgcctacagaagcctggtacacgatcagctatccagacgcagaccatcagcccctatcccgcttagctaagcctgcactatgtggacattgttggatactgtagaggaaagaaggacacggtaaaggaaagagggggaatcagtcttagggtcttaggtacttcagttcaccttaggggcttagcgctgagcacttagcgctaagcccctcaagggctcggcatcagcctgacaggcttagcccatactgcacagccctgaaaggagtacacgccatcagggaaggcttgagagtacgaggagcctcagcgacgagtactcgaaagcctgagggaacacctttagcactgatgggcctagcgcgttcggaaagaacacagaagtaaagtgtgacagctgtccgggagtgaaccccgttctggctaggggtttcagtcttaactacctgtaaaggttacaagactctaagaaaatttaagaaaattcttaagaagaaagttgtgttgttatcccccaaaaaacacccgtttacacccctcaaacccgcctatagagccaaatccgccagtttgactcgtcccaggtggcgtatgctaggctggacaggtagccagctggacgcgaggccagaaagtgctgacgcacttcccgacctcgcttaccatcagtctaccaaacactttaaagcttcaaggctaagccactcagtgctaagcccttaagacctcaacgcttagcaccgagcccttgaggggctcagcattagcactaaggcttaaacacttaataatttaagtaaacataaaagcttttaagacttaaagtaaatatataaccttaacagttaaacgtttaaagctttaaaccttaacacctaagttaggtataaaaccttaaaggcttagcacttaaggatataaacttaacatcagtgtttaagactttaaaacttaaagtaactataagacttaaagacttataagctttaatacttatataataataaagtttaagactgatggttaactttaagtgtttaaagtcttatagttactttaagttttaaagcttataagttataaaagttttagaagagctaaggggttaacttctttacttctctactctctttggttctttctctcttctcttcttttcttcatcaggggagaagaggaacctttaccatcagcgctgatgggctttcacggtgtgtctcgtgtgtctctggtcgcaagctcccatcgcaccctcgccacccctcaccttgaccgtgtctcctttacagcttggtgtgttcggctgaaggcgtacggcgtgtcacgctaacacccttaacaccaggtaagacttaaagtgtatattatatgtagaagactttaaaaactttgaggatgtacacgttttggctgtgacctacaccgctaggcgctaggccttgaaacgcgaacacaccctcccccatttttcttccgtgtccttcttcttttgacacagctggggggcgatgtgatctttctcacatgcaggggtggagggtagaaaacaaccaccccaccacaaacagaacaccccaccaaacgaacaaaacagggcctagaatcgaccagcagggcaagggcaaggtattcatacccccaacgcatttcaggctgttacagaggcaatcagaggcttacagggaccataggtgaacgggaggcgcgatggcacacaccaaccgcaccgcatccgccgcccaccggcgctggcggcaacgactcatcacccaagcccgacaacaaggccaaaccgaatgtcccttgtgtggagccaccatcacctgggacacacacgacctaccaaccagccccgaagccgaccacatcacacctgtcagcaggggaggactcaacaccctcgacaacggccaaatcatctgcagaacatgcaacagaagcaaaggcaacagaacacaaccaaacattcgattccaacaacaaaccacaaaaacattgattccatggtgacaaaccccacaacccccaccggggacaccccctgcacacccgtgcaagacc

SEQ ID NO: 46 - DNA, 29454 bp, Unknown
  source: /note="Description of Unknown: Bacteriophage of P. acnes"
agtgaaatacctcccttttgtggatttatctgtttgtcgactttttgtgttggtggtgagtgttgtgcagcctgagcttcctgggtctcgtgattggtgtggggagacgcttcgctggtggcgtgtgtggggtgaggatagtcgcgcatcgtacgtgtcggatgaggagtggctgtttctcatggatgctgcggtgattcatgattgtgtgtggcgtgagggccgggctgaccttgtggcttcgcttcgtgctcatgtgaaggcttttatgggcatgttggatcgttattcggttgatgtggcgtctggtggccgtggtgggggttctgcggtggcgatgattgaccggtatcggaagcgcaagggggcctgattaggtgtctggtgttgttgggtctcaggtgcctcgtcaccgtgtggctgcggcgtattcggtgactgccggcggggatgctggggaattgggtcgtgcgtatgggttgatgcctgatccgtggcagcagcaggtgttggatgattggcttgctgtcggtggtaatggcaggcttgcttctggtgtgtgtggggtgtttgttccgcggcagaatggcaagaatgctattttggagattgtggagttgtttaaggcgactattcagggtcgccgtattttgcatacggctcacgagttgaagtcggctcgtaaggcgtttatgcgtttgaggtcgttttttgagaatgagcggcagtttcctgacttgtatcgtatggtgaagtcgattcgtgcgacgaatggtcaggaggctattgtgttgcatcatccggattgtgccacgtttgagcgtaagtgtggctgtccgggttggggttcggttgagtttgtggcccgttctcgtggttctgctcgcgggtttacggttgatgatttggtgtgtgatgaggctcaggagttgtcggatgagcagttggaggctttgcttcctaccgtgagcgctgcaccgtctggtgatcctcagcagattttccttggtaccccgccggggcctttggctgacggtagcgtggtgttgcgtcttcgcgggcaggctttgtcgggtggtaaaaggattgcgtggacggagttttcgattcctgacgagacggttccggatgatctatcgaggtcgtggcggaagttggctggggatacgaatcctgcgctgggtcgccgcctgaatttcgggacggtgagcgatgagcatgagtcgatgtcggctgccgggtttgctcgggagaggcttggctggtgggatcgtggccagtcggctacgtctgtgataccggccgataagtgggctcagtctgctgtggatgaggcgagtctggttggcgggaaagtgtttggtatctctttttcgcgatcaggcaatagggttgctttggctggtgccggcaggactgatgctggtgttcatgttgaggttattgatggcctgtcggggacgattgtggatggtgtaggccagctggctgactggttggcgttgcgttggggtgacacggaaaagatcatggttgccggttcgggtgctgtgttgttgcagaaggctttgactgatcgtggtgttccgggtcggggtgttgtggttgccgatactggggtgtatgtggaggcgtgtcaagcctttctggaaggcgtaaggtctgggagtgtttctcatcctcgtgctgattctcgccgtgacatgttggatattgctgtaaggtcggcggttcagaaacataaaggctctgcgtggggttggggttccacatttaaggacggttctgaggttcctttggaggctgtgtcgctggcgtattttggtgcgaaaacagttaaagcgaagcggcgtgagcgtagtggtaggaagcgggtgtctgtggtatgaactcggatgagttggctctgattgagggcatgtttgatcgtattaagagtttgtcttcgtggcattgtcgcattgagggctactatgagggttctagccgggtgcgtgatttgggggtagctattcccccggagttgcagcgtgtgcagactgtggtgtcgtggcctgggattgcggtggatgctttggaggagcgtctggattggctgggctggactaatggtgacggctacggcctggatggtgtgtatgctgcgaatcggcttgctacggcgtcgtgtgatgtgcatttggatgcgctgatttttggtttgtcgtttgtggctatcattcctcatggtgatggttcggtgtcggttcgtccgcagtcaccaaagaattgtactggccggttttctgccgatgggtctcgtctggatgctggccttgtggtgcagcagacgtgtgatcctgaggttgttgaggcggagttgttgcttcctgatgtgattgttcaggttgagcggcggggttcgcgtgaatgggttgaggtggatcgtataccgaatgtgttgggtgctgttccgcttgtgcctattgtgaatcgtcgccgtacttctaggattgatggccgttcggagattacgaggtctattagggcttacacggatgaggctgtgcgcacactgttggggcagtctgtgaatcgtgatttttatgcgtatcctcagcgttgggtgactggcgtgagcgcggatgagttttcgcagcctggctgggtcctgtcgatggcttctgtgtgggctgtcgataaggatgatgatggggacactccgaatgtggggtcgtttcctgtcaattcgcctacaccgtattcggatcagatgagactgttggcgcagttgacggctggtgaggcggctgttccggaacgctatttcgggtttatcacgtctaacccgcctagtggggaggctttggcggccgaggaatctcggcttgtgaagcgtgctgagcggcgccaaacgtcgtttggtcagggctggctgtcggttggtttcctggctgccaagtcgcttgattcttccgttaacgaagctgatttttttggtgatgttggtttgcgttggcgtgatgcatcaacacctactcgggcggctacagcggatgctgtgacgaagctggttggtgccggtattttgcctgctgattctcgcacggtgttggagatgctggggcttgatgatgtgcaggttgaggctgtgatgcggcatcgcgccgaatctgcggatccgttggctgcgcttgctggggctatttcccgtcaaacgaacgaggtttgatggatggcttcgggtgctatgtcgaggctggctgcgactgagtatcagcgtgaggcggtcaggtttgctgggaagtatgcgggctattattctgagcttggccgtttgtggcgtgccggcaggatgagtgacacacagtatgttcgtttgtgtgtggagttggagcgtgccggccatgatggttcggcgtcgttggccgccaggtttgtgtcggattttcggaagcttaacggtgtcgatcctggtttgattgtgtatgacgagtttgatgctgccgcggctttggctaggtcgttttcgactatgaagattatgaatagtgacccggatcgggcgaatgatacgattgatgcgatggcggcgggttttgatcgggctgtcatgaatgctggtcgtgacacggttgagtggtctgcgggtgcgcagggtaggtcgtggcgtcgtgtcacggatggggatccgtgtgctttttgtgccatgttggctacgaggtcggattatacgactaaggaaagggcgctcactactggtcatacgcggcgtcataagcgtggtggtaagcgtccgtttggttcgaagtatcatgatcattgtgggtgtacggtggttgaggttgttggcccttgggaaccgaatagggctgatgccgagtatcagaggacgtatgagaaggctcgcgagtgggttgatgatcatgggttgcagcagtcgcctggcaatattttgaaggctatgcgtactgttggtggcatgagataatttgatgtggtttccggttgtgcgccgccggttatcggtgcacagggttgtctcccgcacgggggtcaacaatgttgtgttgttttccgcaaggagtgtagggttaggctatggccgatcagagtgttgaggaacagaatgttgacaatgatgttgtggagtccggaaagggtgacggcattgttgacacggtgaagggcgatcaaggcaaacaggttgaagatcagtcgaagaatgaaggcgagggtaaatcgccggggactgattggaaggctgaggctcgtaaatgggagtctcgtgcgaaaagtaatttttccgagctggagaagcttcgtacatcgagtgacgattctggatctactattgatgagcttcgccgcaagaatgaggaactcgaagacaggatcaacgggtttgttcttgagggtgtgaagcgtgatgtggctgccgagtgtggcctttcgggtgatgctgtcgcttttctgcacggcgacgatcgtgaagcgctggtggagtctgctaaggctttgaagggtttgatcgaccatagtagtggtggcgcgggtgtgcgccgtcttgcggggagtgcccccgttgatgatgttaaacgacgtgagggtgtcgcgtttgtggatgctcttgtcaataattctaggagatgatttgtgatggctgacgattttctttctgcagggaagcttgagcttcctggttctatgattggtgcggttcgtgaccgtgctatcgattctggtgttttggcgaagctgtcgccggagcagccgactatttttggccctgtgaagggtgccgtgtttagtggtgttcctcgcgctaagattgttggtgagggtgaggttaagccttccgcgtctgttgatgtttcggcgtttactgcgcagcctatcaaggttgtgactcagcagcgtgtttcggacgagtttatgtgggctgatgctgattaccgtctgggtgttttgcaggatctgatttccccggctcttggtgcttcgattggtcgcgctgttgatctgattgctttccatggtattgatccggctacgggtaagcctgctgcggctgtgaagacttcgctggataagacgaagcatgttgttgatgccacggattctgccacgactgatctggtcaaggcggtcggcctgattgctggtgctggtttgcaggttcctaacggtgtcgccctggatccggcgttctcgtttgctctgtcgactgaggtgtatccgaaggggtctccgcttgccggtcagccgatgtatcctgccgccgggttcgctggtttggataattggcgcggcctgaatgttggtgcttcttcgactgtttcgggtgccccggagatgtcgcctgcctctggtgtgaaggctattgttggtgatttctctcgtgtccattgggggttccagcgtaacttcccgatcgagctgatcgagtatggtgacccggatcagactggccgcgaccttaagggccacaatgaggttatggttcgcgccgaggctgtcctgtatgtggctatcgagtcgcttgactcgtttgctgttgtgaaggagaaggcttccccgaagcctaatccgccggccgagaactgatttatttgttgcgataatgttcatgctgtgtgcagggggtggtgttgatgggtatcattttgaggcctgaggatattgagcctttcgccgatattcctaaagataagcttgaggcgatgattgccgatgtggaggctgttgctgtcagtgtcgccccctgtatcgctaaaccggatttcaaatacaaggatgctgctaaggctatcctacgtagggctttgctgcgctggaatgatactggtgtttctgggcaggttcagtatgagtctgcgggcccgtttgctcagactacacggtctagtactcccacgaacttgttgtggccttccgagattgccgcgttgaagaagctgtgtgagggtgatggtggggctggtaaagcgttcactatcacaccgaccatgaggagtagtgtgaatcattctgaggtgtgttccacggtgtggggtgagggttgctcgtgcgggtcgaatattaacggctacgctggccctttgtgggagatatgatatgaccagttttccttacggtgaaacggttgtgatgcttcagccgactgttcgtgtcgatgatttgggcgacaaggttgaggattggggtcatcctgtagaaaccgtgtaccataacgtggctatctatgcttccgtttcgcaggaggatgaggccgcggggcgtgattctgattatgagcattggtcgatgcttttcaagcagcctgttgtgggcgctgattatcgttgtaggtggcgtattcggggtgtggtgtgggaggctgacgggtctcctattgtgtggcatcacccaatgtctggctgggatgctggtacgcaggttaatgtgaagcgtaagaagggctgatggttgtggcacgtgatgtgaatgtgaagcttaatcttcctggtatccgtgaggtgttgaagtcttctggggtgcagggcatgttggcggagcgtggcgagcgtgtcaagcatgcggcctctgctaatgttggcggtaatgcttttgatagggcccagtatcgtgccgggttgtcgtcggaggtgcaggttcaccgtgttgaggctgtcgctaggattggcaccacctataagggtggtaagcgtattgaggcgaagcatggcacgttggctaggtcgattggggctgcgtcgtgatcgtttacggtgatccgcgaatatgggcgaaacgcgtgctcaaggatgatggctggctgtccgatataccgtgtacaggtactgtcccggatgatttcacgggtgacttgatttggttggcgttggatggtggcccgcagttgcatgttcgtgagcgtgtttttttgcgggtgaatgtgttttctgatatgccggatcgtgctatgtctttggcgcgtcgtgttgaggctgtgctggctgatggtgttgatggtgatccggtggtgttttgtaggcgttctactggtcctgatttgttggttgatggtgcacgttttgatgtgtattcgctgtttgagctggtgtgccgtcctgtcgaatccgagtaaacgtatttgttttctatattttgtttttgtttgattatttttgggggttgtgatggctgctacacgtaaagcgtctaatgttcgctctgctgttacgggtgacgtctatattggtaaagctcatgccggtgacactattgatggtgtgaagacggttcctgacggtcttaccgctttagggtatctgtctgatgacgggtttaagattaagccggagcgtaaaacggatgatttgaaggcttggcagaatgcggatgttgttcgcactgtggctacggagtcgtctatcgagatttctttccagctgatcgagtctaagaaggaggttatcgaactgttttggcagtcgaaggttactgccggagccgattcgggttcgttcgatatttctcctggtgccacgacgggtgttcatgccctgttgatggatattattgatggcgatcaggttattcgctactatttccctgaggttgagttgattgatcgtgacgagattaagggtaagaatggcgaggtgtacgggtatggtgtgacgttgaaggcgtatcctgcccagattaataagaagggtgatgcggtgtcgggtcgggggtggatgacggctttaaaagctgatactcctccgactcctcctccggccccgaagcctccgaagcctgagccggatccgaatccgccgtctaataactgatacacatagtttgagggattgttgatagatgagtgacacaggttacacgttgaagattggtgaccgtagctgggtgttggcggatgcggaggaaacggcgcaggctgttcctgcccgcgttttccgtcgtgccgccaggattgcccagtcgggggagtctgcggatttcgcccaggttgaggtgatgttttctatgttggaggctgccgccccagaggatgctgtggaggccttggaggggcttcctatggttcgtgtggccgagattttccgccagtggatggaatataagcctgaaggtaagggtgcctcgctgggggaatagtttggctccacggcctgattgatgattatcgtggggccatcgaatacgatttccgcactaaatttggtgtttctgtttatagtgttggtggcccgcagatgtgttggggtgaggctgtccggctggctggcgtgttgtgtaccgatacgtctagccagttggcggcccacctgaatggttggcagcgcccgtttgagtggtgtgagtgggctgtgctggacatgttggatcattacaggtctgctaatagtgaggggcagccggagcctgtggcgaggcctacggatgagcgtagggcccggtttacgtctgggcaggtggacgatattttggcgcgtgttcgtgccggcggcggggtgtctcgcgagattaatattatggggtgaatagtgtatgtctggtgagattgcttccgcatatgtgtcgttgtatacgaagatgcctggccttaaaagtgatgttggtaaacagctttctggggttatgcctgctgagggtcagcgttcgggtagtctttttgctaagggcatgaagttggctcttggtggcgccgcaatggtgggtgctatcaatgttgctaagaagggcctcaagtcgatttatgatgtgactattggtggcggtatagctagggcgatggctatcgatgaggctcaggctaaactgactggtttgggtcatacgtcttctgacacgtcttcgattatgaattcggctattgaggctgtgactggtacgtcgtatgcgttgggtgatgcggcttctactgctgccgcgttgtctgcttcgggtgtgcagtctggcgggcagatgacggatgtgttgaagactatcgccgatgtgtcttatatttcgggtaagtcgtttcaggatacgggcgctatttttacgtctgtgatggctcgcggtaagttgcagggcgatgacatgttgcagcttacgatggcgggtgttcctgtgctgtctttgcttgccaggcagacgggtaaaacctcggctgaggtgtcgcagatggtgtcgaaggggcagattgattttaacacgtttgcggctgcgatgaagcttggcatgggtggtgctgcgcaggcgtctggtaagacgtttgagggcgctatgaagaatgttaagggcgccttgggctatcttggtgctacggctatggccccgtttcttaacgggttgaggcagatttttgttgcgttgaatccggttattaagtcggtcacggattcggtgaagccgatgtttgctgccgtcgatgctggtattcagcgtatgatgccgtctattttggcgtggattaatcgtatgccgggcatgattacgagaatgaatgcacagatgcgcgccaaggtggagcagctgaagagcgtttttgcgagaatgcatttgcctgtcccgaaggtgaatttgggtgccatgtttgcgggtggcacagcagtgtttggtgttgtggctgcgggtgtggggaagcttgttgcagggtttgccccgttggcggtgtcgttgaagaatcttctgccgtcgtttggtgctttgaagggtgccgctggcgggcttggcggcgtgtttcgcgccctgggcggccctgtcggtattgtgatcggcttgtttgctgccatgtttgcgacgaacgcccagttccgtgccgcggtgatgcagcttgtggctgtggtgggccaggctttggggcagattatggccgctattcagcccttgtttggtttagtggccggtgttgtggcacagttggcgccagtgttcggccagattatcggtatggttgccggtttggctgcccagattgtgcctttgattagtatgcttgtcgcccggctggttcctgtgattacgcagattattggtgcggtgactcaggttgctgcaatgttgttgccggcgttgatgccggtgcttcaggcggttgtggctgtgatacggcaggttgttggtgttgtgatgcagcttgtgcctgtgttgatgcctgtgattcaacagattttgggtgctgtgatgtctgtgttgccgccgattattggtttgatacggtcgctgataccggtcatcatgtctgttatgcgcgtagtggtgcaggttgtttcggttgtgttgcaggtggttgcccgtattattccggttgtgatgccgattgttacggctgtgatcgggtttgttgcacgtattttgggtgctattgtgtcggctgccgccaggattattggggctgttgcccgtgttgtcggatgggttgtgggccatttcgtgtcgggtttggcgcgtatgggttcggttattcaggctggctggaatcatattagggcttttacgtctgcgtttattaacggtttcaagtcgatcatttctggcggcgtgaacgcggttgtcgggttttttacgcggcttggtttgtcggttgcctcccatgtgaggtctggttttaacgcggcacgtggtgctgtttcttctgcgatgaatgctatccgtagtgtggtgtcttcggtggcgtctgctgttggcgggtttttcgggtcgatggcgtctagggttcggaatggtgctgtgcgcgggtttaacggggcacggagtgcggcctcttctgctatgcatgctatggggtctgccgtgtctaacggtgtgcatagtgtactgggttttttccggaatctgcctggcaatattcggcatgctctcggcaatatggggtccctgttggtgtctgctggccgtgacgtggtgtctggtttgggtaatggtattcggaatgctttgagtggcctgctggatactgtgcgtaatatgggttcccaggtggctaacgctgcgaagtctgtgttgggtattcattccccgtcgagggtgtttcgtgatcaggttggccgtcaggttgttgccggtttggctgaggggatcaccgggaatgctggtttggcgttggatgcgatgtcgggtgttgcttcgcagcttccggatgctgtggatgcccggtttggtgtgcgatcgtctgtgggctcgtttaccccgtacgaccggtatcggcgtgctcagggtgagagtgttgtggtgaatgtgaatggcccgacgtatggtgatcctgccgagtttgcgaagcggattgagcgtcagcagcgtgacgctttgaacgcgttggcttatatgtgagtaaaggggtatgcatgtttattcctgacccgtctgatcgttctggtttgactgtgacatggtctatggatccgcggtttggtgatgagcgtgtgcttcatttgacggattatacggggtcgtctccggtgatgttgttgaatgattcgttgcgcggtttgggtgttcctgaggttgagcatttttctcaaactcatgttggggtgcacgggtcggagtggcgcgggtttaatgtgaagcctcgcgaggtgacgttgccggtgttggtgtcgggtgttgacccggatccggtgggcgggtttcgtgacggttttttgaaagcctatgacgagttgtggtctgcgtttcctcctggcgaggagggggagctgtctgtgaagactcctgccggtgtagagcgtgtgttgaagtgccggtttgattcggtggatgacacgtttacggttgatccggttaatcgtggctatgcgcgttatgtgcttcatttgacggcctatgacccgttttggtatggggatgagcaaaagtttcgtttcagtaacgcaaagttgcaggattggttgggtggcggccctgtcggcaaaaacgggactgcttttccggtggtgttgacgcctggtgttggttcgggttgggataacctgtcgaataagggtgatgtgcctgcgtggcctgtgattcgcgttgaggggccgttggattcgtggtcggtgcagattgatggtttgcgtgtgtcttcggactatcctgtcgaggagtttgattggatcactattgatacggatcctcgtaagcagtctgcgttgttgaacgggtttgaggatgtgatggatcgcctggatgagtgggagtttgcgccgattccgcctggcggttctaagagtgtgaatattgagatggttggtttgggtgccattgttgtgtcggtgcagtacaggtttttgagggcgtggtgaattgttgtggctggtcttgtcccgcagataacattgtttacgccagactatcatcgtgtggcgcctatcaatttttttgagtcgctaaaattgtcgttgaagtggaatggtttgtcgacgctggagttggtggtgtctggtgatcattcgaggcttgacgggttgacgaggccgggtgcacgcctggttgttgattatggtggtggccagattttttctgggcctgtgcgtaaagtgcacggggttgggcctcggcggtcttcccgtgtgactatcacttgtgaggatgatattcgcctgttgtggcgtatgttgatgtggcctgttaattatcgccccggtatggtgggttctgagtggcgtgcagaccgggattatgcccactattctggtgcagccgagtctattgctaagcaggtgttgggggataatgcttggcgttttccgcctggtttgttcatgatagaggatgagaagcgtggccgctatattaaggattttcaggtgcggtttcacgtgtttgcggacaagttgttgcctgtcctgtcgtgggctcggatgactgtttcggtgaaccagtttgagaatgcgaagacggatcagcgggggctggtgtttgattgtgttcctgctgtgacgcgtagccatgtgttgacgtccgagtcgggttcgattgtgtcgtgggagtatgtgagggatgcccccaaggctacgtcggtggttgttggtggccgcggcgagggtcgggatcggctgttttgtgaggatgttgattcgatggccgagggggactggtttgatcgtgtcgaggtgtttaaggatgcccgtaacactgattcggataaggtgtctctttacgatgaggcggagcaggtgttgtcggaatcacaggccacgtctggttttaagatcgagttggccgagtcggatgtgttgcgttttgggcccggcaatctgatgcctggggatttgatttatgttgatgtgggttcggggcctattgcggagattgttcggcagattgatgtggagtgtgattcgcctggtgacggctggacgaaggtgacaccggttgcgggggattatgaggataatccgtcggcgttgctagcgcggcgtgttgccggtttggctgccggtgtgcgggatttgcaaaagttttaaaaaagctcaacggattggggtttgttgtgggtattgtgtgcaagggttttgatggtgtgttgaccgagtatgattgggctcaaatgtctggtctgatgggtaatatgccgtcggtgaaaggtccggacgattttcgtgtcggcacgacgattcagggtgccacagtgttgtgtgaggttttgccggggcaagcgtgggctcacggggtgatgtgtacttcgaatagtgttgagacggtgacgggccagctgccgggtcctggcgagacgagatacgactatgttgttctgtcgcgggattgggagcagaatacggcccggttggagattgttcctggggggcgtgcggagcgtgcccgtgacgtgttgcgtgccgagcctggcgtgtaccatcagcaactgttggctaccctggtgttgtcgtctaacgggttgcagcagcagctggataggcgtgccgtggcggctagggtggcgtttggggagtctgctgcgtgtgaccctacccctgtggagggtgaccgggtgatggttccttcgggggctgtgtgggctaaccatgctggcgagtggaggctgttgtctccgcgtatcgagacgggttcgaagtcgatcatgtttggtggatctaatgtgtatgcttacacgatcccgtttgatcgccagtttactagtccgcctgttgtggtggcgtctatggggaccgcggctgggggtacgacacagattgatgtgaaagcctacaatattactagtaaggattttggtttggcgtttatcacgaatgacgggtctaaaccgaatggtgtgcccgcggtggctaactggatagctgtgggcgtgtgacggtacaggcgttgtggtggctggtgtgatgttgggggggctgccgtgtcgtggatgactcctgcattggtggcttctatttgtaccgcgttggccacggttttgggttctgttcaggctatcacatcccggtctagaaagcgtttgcgaaggttgtctgcgcaggtggatgctttggaagagtatacgtggggtgtgcggcgtgaggttcgccggtttaacgccaggcttcctgacggggttgatccgcttgtgttgcctgagccgcctggtttcctatcggatgatgttgggggtgagtgatgagggagttggaggaggagaagcggcagcgtcgctcgtttgagagggcttccctgctgttgttgtttttgtcgcttgtgctgttgattgtggttgctgggggtgctttgcgtttcggggctgtatcctctgaacgggattctgagcaggcgagggcccagtcgaatggtacagcggccaggggtttagccagccgtgtgcggcaggtgtgtgcccatggtgggatggagtcggtacggcttcaccggtctggtttgtgtgtggatgctgtgcgtacggagcggagtgttcagggtgtgccgggcccggctggtgagcgcggcccgcaaggccctgcaggtgctgatgggcgtgacggtgttaatggttcgtctgggctggttggccctgttggtccgcagggttctcccggcttgaatggcgtgaaaggtcctgacgggttgcctggtgcaaatggatcggatggccgtgatggtgttccgggccgtgcaggtgttgacggcgctgatggtcgggatggttcggctggtgagcgcggtgatgtgggtccttcaggtcctgccggcccgcaaggtgcacagggggaacggggtgagcgtggccccgtcggtgcgaacggatccgatggtaaagatggtaaggatgggcgctcggtggtgtctgtgtactgttctgatggtctcctggttgtgaaatatagtgacggtgtggcttctacaatatcgggctcggtggcctgccagggtgtgaaaccgtcgcctatggtgactatatcatcccacaaatagaaaggagtggctgtgatggtagtgtttggtggtggtgtgtggtgaggtttatcccagcagcgcaccattctgccggttcgaatagtccggtgaatagggttgtgattcatgcgacgtgcccggatgtggggtttccgtccgcctcacgtagggggagggctgtttctacggcaaactattttgcttccccatcgtctgggggttctgcccattatgtgtgcgatattagtgagacggtgcaatgtctgtctgagtctacgattggttggcatgccccgcctaaccctcatagtttgggtatagagatttgcgcggatggtggctcgcacgcctcgttcagggtgccggggcatgcttacactcgtgagcagtggcttgaccctcgcgtgtggcccgcggtggagcgtgccgcgatcctgtgtagacgtttgtgtgacaaatataatgttccgaaaaggaagcttagtgcagccgatttgaaggctggcaggcggggtgtttgcggccacgtggatgttacggatgcgtggcatcagtcggatcatgacgatcctgggccgtggtttccgtgggacaaatttatggccgtagtctgcggcggtagtggtagtgaggagttaactgtggctgatgtgaaagccttgcatgatcagattaaacaattgtctgcccagcttactggttcggtgaataagctgcaccatgatgttggtgtggtacaggtacagaatggtgatttgggtaaacgtgttgatgccttgtcgtgggtgaagaatccggtgacggggaagttgtggcgcacgaaggatgctttgtggagtgtctggtattacgtgttggagtgtcgcagccgcattgacaggcttgagtctactgttaacggtttgaaaaagtgatggtggtttgttgtgggtaaacagttttggttaggtttactggagcgggccctgaaaacttttattcaaacgtttgttgccgtgctcggtgttactgcgggtgtcacgtatactgcggagtcgtttcgcggtttgccgtgggagtcggcgttgatcacagccacggttgctgcggtgttgtcggttgctacttcgtttggtaatccgacgtttgtggctggtaagccgaagactacggttgtggataccgggcttgttccacccgatgataccggtttgatagaaccgcatgcggtggatgtgtcggatcctggcatgattgagccgatggatgatgcggatgttgccggctatgtgccgaagcgggctgccgagtcggaggttggcacagtagagtctactgttgcataattgaatatgtgtgtgccccagcggtgctgccacgattgtgtggtggttgccgctggggcacactttttgtttatgcgatatggctatgattcgttgctgtcgatggtgtcttcgagcatctgatacaggtggaggcaggtgcagatggtttcgctggcctggtcgagaacgtttcggccgataacgtttttgtggttgtcgcggtggcggatgatagcccacatgatctcgtcggctgccgcctgtaatagttttgcctggtatgcgattccggcgagccagtctagtgcttcctggcttgcctgtgtgtcgtctggaataccacgggtgttgctgttgcttgggtgtccttcactgtcgcatagccacaggatttcgctgcactcgtctagcgtgtcctggtcgatagcgagatcgtcgaggctgacattgttgacggtaaggttcacgttgtcgagggagatgggtacaccgtactggttttcgacactgtcaacaatgttttgtagttgttgcatgttggtgggctgttgttggatgatacggtgtaccgctgctttgagggcagtgtaggggatattgtgtgtgttgttcatggttttatttcatccctgtgctgtcgtcgttatcgtctggatagtatctactgtttgcgtaccctgttagggtgatcaatgtttggtctgcccactgtttcacggtttgccgggttacccctaatcgttgggctgctaccgaataggtttgatcatacccgtatacttcccggaatgctgccaaccgtgctaggtgttttcgctgtttggatggctggcaggtgagggtgtagtcgtcgatggccagctggaggtcgatcatggagacgatgttgttgccgtgatgctggggggcggttggtgggggtggcataccgggttctactgatggtttccatgggccgccgttccagatccattgggcggcttggataatatctgcggtggtgtaagtccggttcactggtcaccccctgaacaggttgtcgaggttgtctgggttactggtgttggtggtgtcgaatcgtcccacacagtggcagtagtcgtacatgagtttgataatgtgttggtggtcgccgaggtaggtgttgccactaatactgtaggtggctgtgccgtctttgccgataatgtatttggcggtgatggtttctggtgtttcggtgttggtgatgattgctgttgtggtggtgcctacggtttgtagcctggtggtttgggttccgtcgtcgagggtggtggtaaccataattggggttttccttaaatgcttgtctggttgtcggctagatgaataatatcggataaaggtttcggctggtctaggtgctgtaccgctttgttggctaaacgtttggctaccctgtaacacattttggtatagtgtttgttgtctaggttgtggtattgttcccgcaccgcaatatatagtagggagtcttggtacaggtcgtctgcactgattgcggggtagtgggtggctactttgatgcatgaccggttgagtgtgcgaagatgatggtcggtggtccatccccacgatgcggtggtggcccggtctgcttttgttggtcgtctactcatggcactatttcatctcgctatctggtagttgtttggtgttttatggttgatagtgtagcacacgagtccggggttgccggtggtgcccgtcttgtgccggtaccatgtggattcgccttccatggatgggcattggatgaaggtgcgttgtccttgctcggagatttctaggtggtgtcggtgcccggccatgaggatgtgggatgtggttccgttgtggaattcttgtccgcgccaccaatcatagtgtttgccggtgcgccattggtgtccgtgggcgtgcaggatttgtgtgcctgccacattgacggtggtggtcatttcgtctcggctggggaagtggaagtgtaggttggggtattggttgttgagttggtaggcttcggcgatggcgcggcagcagtccacgtcgaaggagtcgtcgtaggtggtgacgcctttgccgaagcgcacggcttcaccgtggttgccggggatggatgtgaccgttaggttggcgcagtggtcgaattggtggatgagttgcatcatggccatgcgggtgagccggatttgttcggtgaggggtgtttgtgtgcgccaggcgttgttgcctccttgtgacacgtatccttcgatcatgtcgccgaggaatgcgatgtggactcgttgcggtttgcctgcctgttgccagtagtgttttgcgactatgagggagtgcaaatagtcgtcggcgaagtgtgctgtttctcctccggggatgcctttgccgatttggaagtctcctgccccgatgacgaaggccgcagtgctgtagtcggtgcgggtgtcttgttcgggttttggtggctgccattcggctagtttatctacgagttcgtctacagggtaggggtttgttgcgggttggtggtcgatgattttttgtacggatcggccggtttctccgttcggtaaggtccattcggagatgcgtgtgcggcgtacagtaccattggctagattgtcgtcgatggtgtcgatggcgttgtcgtggttggctagctgtgtgagtagccggtctatattgtctatcactgggtatcctcttcctcgtgtggggtggtgttggcttgtttgcggcgatagtctttaataacggtggcggagatggggtatccggcttgggtgagctgttttgctagccatgaggcggggatggttttgtcggcgaggacgtctgcggctttgttgccgtagcgttggataagggtttcagttttggttgccatgatatcctaggggttgtgtggcgggttgccatcctgtgcggcagtcgccgtcgtgtcctggcttacgggtgcaccatgtgatggttccgtctgtgtggtggagttttttgccgcacatgacgttttgtagatgctccggcagctggtcggtgttgttgctggtttgtatgtcgaagagtgttttctggttggtgaaatgctctgacacggtgccattatgcacgggtagtatccatgttttccattgctgttgtagcctggtgttccagtggaattgtttggcggcgttttcggcctgttttaaggttttgtagtagccgactagtatgcgctggtgttcactgtcgggtgggttttggcctcgccaatattgtgccgccacggcgtagcggttgctggctgtgaaggcgtcccagcagtattcgataatgtgttgtagtgcactatcgggcatgtcttgtatttggttttcgttaagccattcttcaacaaggatgttgtgtatggcgcgtttgtctttgatggttggtttgaacgagatgctcacgatagtaccggctggtcgtcttgcatgaactggttgaaggtgttgtttccggcgtgttgggcttgtgtgatgtcctggtcggtccagtcggggtgttgctgtttcagatagtgccagtggcacgcattgtaggtttcgtcttgtagccgtgtgagatggttttcggtgatgatttgtttccacattgtccatgacacgtcgagccggttgaggatttcgagggctgggatgttaaattggttgaggaagagtatttcgtgggtgtagtagtttttctcgtaggcgtcccatccgcttcggtgcctgttgggctggtttttggggtaggcttcccggcatactttgtgcaaatgtttggccatgtcgtcgggtagtttaatgtcggggttggcgcggatcatggatcgcataccatcataggtggtgccccaggtgtgcataatgtaggtggggttttctccatcagcccatttttctgcacagatggcgaggcggatgcgcctcctggctgcttggctaatgttgcgccggttggggatggggcacgtgtctaggggatccatgatgttttagtgtacctttctttgttggggttgcttgtgtggttttattgtagcactgtgttgagtgcttgtgtcaaccctgttttgccggcctgaaggtaggtgtctgtgacatcccccagggtgaggggcacgtgtacggcttgggggagtgctgtttggagggtttgggccatcttgtctcccgcggggtcgggatcggaccagatgtaaacatggtcgtagccttcgaagaatttggtccaaaagttttgccacgaggttgcgccgggtatggcgacggccgaccatccgcattgttcgaggatcatggagtcgaattcgccttcgcaaatgtgcatttcggctgccgggttggccatggcggccatgttgtagatggagcccgtgtctccggccggggttaagtatttggggtggttgtgttctttgcagtcgtgtgggagtgagcagcggaaacgcatttttcttatttcggctggccgcccccaaacggggtacatgtaggggatggtgatgcactggttgtagtcttcgtggcctgggatggggtcattgtcgatgtatccaaggtggtggtagcgggctgtttcttcgctgatgcctcttgctgagagaaggtcgagaatgttttcgaggtgggtttcgtagagggccgaggctttctggattcggcggcgttccgcaatgttgtatgggcgtatgctgtcgtacattcgggtttctttcttcgagttgttgttgtagtttggcgaggccgcctccgacaccgcatgtgtggcagtaccagacgcccttgtcgaggttgatgctcatggagggttggtggtcgtcgtggaacgggcagaggatgtgttgctcgttcctggacgggttgtagcgtatccggtaggtgtcgaggaggcggcaggtgtcagaggtgtgggaggagttctgcgagggttgataccacataggcttcgctccatggcttgttgcgctgtttcatgaccactaacccgattgtggatttgtcaaccaggttgcggtgggtttcatagttgcgcgcctcccggctggcttgtttcacgaattgggcgagatgttgctgtcctgctttcgcttcgatcacataggttttgtggccggttgtgaggatgaggtcgccttcgtcttcgtggccgttgaggtgtagccgttcgatgtcgtgtccgatgtcacgtagctggtgcaataatcgtgtttcccactcggcaccggcccggcggttgcgtgattgctgtgtagccatcataatcctttgtgtgttgtggccatgttccatggctgtttttcggctagtggtccgaagaatgtgtattcggggtaggctcgtagccgttcgtatcgggtgccgtctgggctggatttgcctgtgcgctgtttcaacactgcgatgcgcgcctctgccggtatcgatagcccgttgccgttatcctcgccaccatacaatgagactccgaggatgagttgtggtttctcggatagcccgtttttgatctctcgtctggcgggcgggtgttcgatgtcggagccggttttgtcggttgcgtggtgtgtgacgataatggtggagccagtatccctacctaatgctgtgatccattgcatggcttcttgctgtgcctggtagtcactctcgcagtcttggatgtccatcaggttgtcgataacaatgagtggtgggaaggtgttccacatttccatgtaggcttgcagctccatggtgatgtctgtccatgtgatgggtgactggaatgagaatgtgatgtgttggccgtggtggatgctgcctcgatagtattctggcccgtagtcgtcgatgttgtgttgtatttgggcggttgtgtgttgggtgttgagggatatgattcgtgtggaggcctcccagggtgtcatgtcccctgaaatatatagggcgggctggttgagcatcgcggtgatgaacattgctagcccggatttttggctgccggaccgccccgcaatcatgacgagatcccctttgtggatgtgcatgtcttggttgcggtagaggggttctagttgtggtatacggggcagctcagcagcggtttgggaggctctctcgaaggatcgttgtagagagagcatcgggaccttaatctatctatctgttacggtttggatgaatattggcggtcagatggagtcgatatctacatcatcgctgccggtggtgttgggctggctgtctcgctggtcaacgtaggcggctacaaggtcgtagatggcgtcgtctaggggtttgaggatgacagcgttgaacccgtttttagtgcgcactgtggcgagtttgaaggcctgctcctcgccgaggtaggtttcgagttcgcggatcatggagtgtgggcggtcgttgttgcctcgcgctttttcgatgatagcgttggggatggtttctggggtgccgttgttgaggtcgtcgagggtgtggaagatagtaacgtcggcgtaaatacggtctgcgacctgtccgccgtagccttcggtgttgtgttccacgtcgtggattttgaaggcgatggcggtggcgtcctggtttttggacgggttgaagaaggtgctgctgttgctgttgttgcggtagttggcgagtcccataacttttgtccttttgctgtttgtgttgttttgttgtcttatattggtttatcgggtgaggctgtttcgtttagtgcggaacgcctcagacacgtcactgttactggtgatgatctttttgtactgtttcaagaggtctgctaattgtgctttactggtggctttgttgatcctgtcgatgataatgtcgttttcttgattggcgattttgttgacgtagtctttggctgctttgtcgtatcggtcttggaggatgatggatgcgctcgctacgagcgttgccagatcccagtctttggagactgtttcgtctttgagtccgcctagcaggtcgatgatggcctgttttgtctgctctgctgtgtctcctcggatgaccgcccatggtgcagcatagtctccaccatatttgagtgtgatagtgagtcgatcattgtctgtggtgcgctcttctgtcacttgttttccttttctttattgtctgcttggggtggctgtacggtggattctaccgggtatctgtaggcgtctttcccgtctaccgcccagcaggcgtcctgtacggggcatcctttacagagtgctgtaacatgtgggacgaagatgcctttgctgattcctttcattgcttgactgtacatggatgatacatgccggtaggtattgttgtcaagatcgtacagttcggttgctgtgccctgagtttgcgatgtggtgttgtttcggctgctggcgggtgtccaaaacatgcctttcgtcacgttgatgtcgtgttggttgagcatgtaccggtaggtgtgcaactgcatggcatcaacagggaggcgacccgttttgaggtcgagaataaacgtctcaccagtgtcggtgtcggtgaagatacggtcgatgtagccaacaatctttgtgccgtcctggagggtggtttcgactgggtattcgatgcctggctggccgtcgagtattgctgtgtggtattgtggatagtttgtgcgccactgtttccacctgtcgacgaagatggggccatagatcatccaccagtcgtagtctttcttgtgtggcccgcctgactcgcacatgtttttgcacactctgccggagggtttgatttctgtgccttcggattcgacgagggcaacttgggtgtcgaaaacgtttttgaaggatgagagtttgtctggcagtgcagggtattcgtcggggttgtacaggtggaggtcgtactgttcggtgatgtggtgtatggcgcttccggcgatggttgcgtaccaggtgtggtgctgtgcatgatagccgtgggataggcgccatttttctccgcattcggcccactgggtgagtgaactgtaggagatgtggcctggatggttgatggttttcggatattgtgctagaggcattacttgtcgcttttgttccatgggttgcgggtgtcttggccggcattgtgttgctggtaggcgaggagtgctaggcagtgccaggctgcgtgtgccaggtgtggcaggtgtgattcatcgtcgaggttgtttccttgctgccaggatagcacatggcggtagagggcgtcgacactgtgacaccaggggtatcctccggtccagttgttgtcgccgtatttggtggcaccgtagcctgctacttcgcctagggcgtgcaaggctacggggtcaatgagggagagcctgcagagtttgagttcttttcgggcacctgtgtcggggtcggtgtacatgcgggtgggctcatccatggggggtgtgtgcctttcttggtttgggttactggttgttgtcgtgggctagtgctactgcgagaataatgatggcgagggtttcagcaataagtatgggtgttgtgatcatttgctgtctcggggattgttggtgagggttgaggcacccaggagggtggcgagggcgcatgcggcgataatggcgagggctgccttgtggggggtgccggttgcgtacatccatgtgatgatgccgccttggatccatgccagtgtggtgaagaaggtttcgtaactgtgcaactcgatactgttgggtgtgttcatgctcgctcctgaagaatggtgttgatggttttgtaaatgttgtacaggtcggtttcgatagataacagttggtggatttggtggtcgaggttgatatctgggttgagggtgttgatgcgggatgcgatgtcggtggctgtgcgtagtgtgccgccggtgtggtgaataatgtgtgcggtgtcggcgagtccggtggtgacagcatagtgggagaggagaggcatagcggggatgctccttggcgggttactgttgcgggttgatgttgaggtcggtgacgtgcgggtggtcttctgttcctgtgatgaggcagtggacggtgactgggagtttggatgcgccgggctgtttcatggttgcgccgtagacgatgctgaacgtgtctttaccgatggttttgtggagttggaggtcgatgtcggggttgccgttccagttgacgccgtgtgcggcggccttctgttcggctttacggttgcaggtgtgtgctgcggtgatcatggtgagaccctgcgcggtttcttcaccccttgcttgggcttgcttgtgggttttggcttgttcggcttgtagggagcgggtggcggctgcctgccgtgccgctttctcggctttgcgctgttgggcggtttttggtgtccattctgtgttggctgtggttacctgtggtgcgggttgtgatgcgagtggggggttgtcgtcgggggctgggaggaaggatgcggcggcgatgatggcggctgtgattccggcgatggtgtagccgtttttcttgttcatgactgttatcccctttccggggtgttgttcgttgctgacatgattgatacttccagacggggctatgactgtcaaggtgtcgctcagtttgtgtgagcgatccttgtgtggctgggggttatcgggcgaacagggtgagtaggtgtcctaagttgatgcgactcacgttccagtagagttgcgtggcttcaccgccagtgagcggcttccacttgttgtggctgaacactgtaccgtcggatgctatgaacgtgtcggggcgtagcttgtgaagttcagtctctacgctctgccggtaggcttcggcgaggccctcaaaatccatgtggtcaccggagaggttttcgaggcgtgtcaggtcgaagggtgtggggcagtcgtagctggcgggggtgtagagctgggtgaagtggtcggcgatcttttgcatcatgattccttttctagtgtggtgggttaatagttttatcgggtggatgcgacaaggatggcgtctatgtcgatcatgtcgatgagatcgtggagttcctcggcctcattctcagataggtggcgccagtcgtagtcgccgtacacggcgccgtcgagggtgacagtccacaggggccggatgagccgtatggcttcttgtactttggcgtggtacatgcggcgcaccatatccagatcgatgtcgtctgaatggtttccggtgaggctgtggagactgagggggtcgatttctgtctgctggtagaggctggtgaaggatggggtgatgagtgtgccatccatgggggggtgctcctttctggattgtttgggttggttgttgtggtttctaggatgtgtaggttgcgacccacagtcaaggctgcgctcaatccgaatgagcgtttagcgtgtgtggcatgggatgtggcgtatctcacttaagccttccttgcctctctaggcgtctcaaatcttctgggggtaggattatatagggttgaccctgctgatcgattctagagcccttctagggcctctcgggggtatgtctgagtgatgacgggtgtggcagatgatctagcgagtcaaggtgccgagcttagacataaaatctatcatctaggtgtgtgagatgtatcacatcctcctggcttggtgtgcactttcaaggctactctgtcgatctgacgtggagggtgtagcccagaaataccgtttaaagccactgggagacgcctagaagcgccttacggggtgggggctaggtatttatacccccagcatattctgatcgattctagacgcctacagaagcctggtacacgatcagctatccagacgcagaccatcagcccctatcccgcttagctaagcctgcactatgtggacattgttggatactgtagaggaaagaaggacacggtaaaggaaagagggggaatcagtcttagggtcttaggtacttcagttcaccttaggggcttagcgctgagcacttagcgctaagcccctcaagggctcggcatcagcctgacaggcttagcccatactgcacagccctgaaaggagtacacgccatcagggaaggcttgagagtacgaggagcctcagcgacgagtactcgaaagcctgagggaacacctttagcactgatgggcctagcgcgttcggaaagaacacagaagtaaagtgtgacagctgtccgggagtgaaccccgttctggctaggggtttcagtcttaactacctgtaaaggttacaagactctaagaaaatttaagaaaattcttaagaagaaagttgtgttgttatcccccaaaaaacacccgtttacacccctcaaacccgcctatagagccaaatccgccagtttgactcgtcccaggtggcgtatgctaggctggacaggtagccagctggacgcgaggccagaaagtgctgacgcacttcccgacctcgcttaccatcagtctaccaaacactttaaagcttcaaggctaagccactcagtgctaagcccttaagacctcaacgcttagcaccgagcccttgaggggctcagcattagcactaaggcttaaacacttaataatttaagtaaacataaaagcttttaagacttaaagtaaatatataaccttaacagttaaacgtttaaagctttaaaccttaacacctaagttaggtataaaaccttaaaggcttagcacttaaggatataaacttaacatcagtgtttaagactttaaaacttaaagtaactataagacttaaagacttataagctttaatacttatataataataaagtttaagactgatggttaactttaagtgtttaaagtcttatagttactttaagttttaaagcttataagttataaaagttttagaagagctaaggggttaacttctttacttctctactctctttggttctttctctcttctcttcttttcttcatcaggggagaagaggaacctttaccatcagcgctgatgggctttcacggtgtgtctcgtgtgtctctggtcgcaagctcccatcgcaccctcgccacccctcaccttgaccgtgtctcctttacagcttggtgtgttcggctgaaggcgtacggcgtgtcacgctaacacccttaacaccaggtaagacttaaagtgtatattatatgtagaagactttaaaaactttgaggatgtacacgttttggctgtgacctacaccgctaggcgctaggccttgaaacgcgaacacaccctcccccatttttcttccgtgtccttcttcttttgacacagctggggggcgatgtgatctttctcacatgcaggggtggagggtagaaaacaaccaccccaccacaaacagaacaccccaccaaacgaacaaaacagggcctagaatcgaccagcagggcaagggcaaggtattcatacccccaacgcatttcaggctgttacagaggcaatcagaggcttacagggaccataggtgaacgggaggcgcgatggcacacaccaaccgcaccgcatccgccgcccaccggcgctggcggcaacgactcatcacccaagcccgacaacaaggccaaaccgaatgtcccttgtgtggagccaccatcacctgggacacacacgacctaccaaccagccccgaagccgaccacatcacacctgtcagcaggggaggactcaacaccctcgacaacggccaaatcatctgcagaacatgcaacagaagcaaaggcaacagaacacaaccaaacattcgattccaacaacaaaccacaaaaacattgattccatggtgacaaaccccacaacccccaccggggacaccccctgcacacccgtgcaagacc

SEQ ID NO: 47 - DNA, 29491 bp, Unknown
  source: /note="Description of Unknown: Bacteriophage of P. acnes"
agtgaaatacctcccttttttggttttgtctgtttgtcgactttttgtgttggtggtgagtgttgtgcagcctgagcttcctggtagtcgtgattggtgtggggagacgcgtcgttggtggcgtgtgtggggtgaggatagtcgcgcgccgtatgtgtctgatgaggagtggttgtttctcatggatgctgcggtgattcatgattgtgtgtggcgtgagggtcgcgcggatttggtggcttcgcttcgtgctcatgtgaaggcttttatgggcatgttggatcgttattcggttgatgtggcgtctggtggccggggtgggggttctgcggtggcgatgattgaccggtataggaagcgcaagggggcctgattaggtgtctggtgttgtgggttctcaggttcctcgtcatcgtgtggctgcggcgtattcggtgtctgctggcggtgatgctggggagttgggtcgtgcgtatgggttgacgcctgatccgtggcagcagcaggtgttggatgattggcttgctgttggtagcaatggcaggcttgcttcgggtgtgtgtggggtgtttgtgcctcgccagaatggcaagaacgcgatccttgaggttgtggagttgtttaaggcgactattcagggtcgccgtattttgcatacggctcacgagttgaagtcggctcgtaaggcgtttatgcggttgaggtcgttttttgagaatgagcggcagtttcctgacttgtatcgtatggtgaagtcgattcgggcgacgaatggtcaggaggctattgtgttgcatcacccggattgtgccacgtttgagaagaagtgtggctgtccgggttggggttcggttgagtttgtggcccgttctcggggttcggctcgcgggtttacggttgatgatttggtgtgtgatgaggctcaggagttgtcggatgagcagttggaggcgttgcttcctacagtaagcgctgccccgtctggtgatccgcagcagattttccttggcacgccgcctgggccgttggcggatggttcggttgtgttgcgtttgcgtgggcaggctttgtcgggtggtaaaaggtttgcgtggacggagttttcgattcctgacgagtctgatccggatgatgtgtcacgccagtggcggaagcttgcgggggatacgaatccggcgttgggtcgccgcctgaatttcgggaccgtaagcgatgagcatgagtcgatgtctgctgccgggtttgctcgggagcggcttggatggtgggatcgtggccagtctgctgcgtctgtgattccggcggataagtgggctcagtctgctgtggatgaggcgagtctggttggcgggaaagtgtttggtgtctcgttttctcgttcgggggatcgtgtcgctttggcgggtgccggccggactgatgctggggttcatgttgaggttattgatgggctgtcgggaacgattgttgatggtgtgggccggttggcggactggttggcggttcgttggggtgatactggccggatcatggttgccgggtctggtgcggtgttgttgcagaaggcgttgacggatcgtggtgttccgggccgtggcgtggtggttgccgatactggcatctatgtggaggcgtgtcaagccttcctggaaggtgtaaggtctgggaatgtttctcatcctcgtgctgattcgaggcgtgacatgttggatattgctgtgaggtcggcggttcagaaaaagaaaggctctgcgtggggttggggttcctcgtttaaggatggttctgaggttcctttggaggctgtgtctttggcgtttttgggggctaaacgtgttcgtcgtggccgtcgggatcgtagtggtaggaagcgggtgtctgtggtatgaacgtggacgagttggctctgattgagggcatgtacgatcgtatccaaaggttgtcttcgtggcattgtcgtattgagggctactatgagggttctagccgggtgcgtgatttgggggtggctattcctccggagttgcagcgtgtgcagactgtggtgtcgtggcctggtatagctgtggatgctttggaggagcgtctggattggctgggctggactaatggtgacggctacggcctggatggtgtgtatgctgcgaatcggcttgctacggcgtcgtgtgatgtgcatttggatgcgctgatttttggtttgtcgtttgtggctgttattccccaggatgatgggtcggtgttggttcgtccgcagtcaccaaagaattgtactggccggttttcggctgacggttctcgtttggatgcgggtttggtggtgcagcagacgtgtgatcctgaggttgttgaggcggagttgttgctgcctgatgtgattgttcaggtggagcggcgtgggtctcgtgagtgggttgagacgggccgtataccgaatgtgttgggtgctgttccgttggtgcctgttgtgaatcgtcgccgtacgtcgaggattgatggccgttcggagatcactcggtcgattcgtgcttacacggatgaggctgttcgcacactgttggggcagtctgtgaatcgtgacttctatgcgtatcctcagcgttgggtgactggcgtgagcgcggatgagttttcgcaacctggctgggtgttgtcgatggcttctgtgtgggctgtggataaggatgatgatggtgacaccccgaatgtggggtcgtttcctgtgaattctcctacaccgtattcggatcagatgcgtttgttggcgcagttgactgcgggtgaggcggctgttccggaacgctatttcgggtttatcacgtctaacccgccttctggggaggctttggctgcggaggagtctcggcttgtgaagcgtgctgaacgcaggcagacgtcgtttggtcagggttggttgtcggttggtttcctggctgcccgggcgttggattcgagtgttgatgaggccgcgttttttggtgatgttggtttgcgttggcgtgatgcttcgacgcctacccgggcggctacggctgatgctgtgacgaagcttgttggtgccggtattttgcctgctgattctcgtacggtgttggagatgttgggtttggatgatgtgcaggttgaggctgtgatgcggcatcgtgccgagtcttcggatccgttggcggcgctggctggggctatttctcgtcaaactaacgaggtttgataggcgatggcttcgggggctatgtcgaggcttgctgcgactgagtatcagcgtgaggctgtcaggtttgctgggaagtatgcgggctattattctgagcttggtcgtttgtggcgtgccggcaggatgagtgacacgcagtatgttcgtttgtgtgtggagttggagcgtgccggccatgatggttcggcatcgttggctgccaggtttgtgtcggattttcgccggttgaatggtgtggatccgggtttgattgtgtatgacgagtttgatgctgcggcggctttggctaggtcgttttcgactatgaagattcttgagagtgacccggatagggcgaatgacacgattgatgcgatggctgcgggttttgatcgggctgtcatgaatgctggccgtgacacggttgagtggtctgcgggtgcgcagggtaggtcgtggcgcagggtgactgatggtgatccgtgcgcgttttgtgccatgttggctacgaggtcggattatacgactaaggaaagggcgcttactactggtcatacgcggcgtcataagcgtgccggtaggcgtccgtttggttcgaagtatcatgatcattgtggttgtacggtggttgaggttgttggcccttgggaaccaaatagggctgatgccgagtctcagaggacgtatgagaaggcccgtgagtgggttgatgatcatgggttgcagcagtcgcctggcaatattttgaaggctatgcgtactgttggcgacatgagatgatggtttccggttgtgtgccgccggttatcggtgcacagggttgtctcccgcacgggggtcaacaatgttgtgttgttttccgcaaggagtatagggttaggctatggccgatcaaaaagttgaagaacagaatgttgacaatgatgctgttgagcccggaaagggtggagacgttgttgatgttgtgaaggatgggcaggcttccggcgatgatcatgccggtgatgtttccgtgaaggaggagtcttcttctggcacggattggaaggctgaggcccgtaagtgggagtctcgtgctaaaagtaatttcgccgagttggagaagcttcgtacatcgagtgacgattctggatctactattgatgagcttcgccgcaagaatgaggaactcgaagacaggatcaacgggtttgttcttgagggtgtgaagcgcgaggtggcttcagagtatggtttgtccagtgatgcggtcgctttcttgcacggtggcgatcgtgaagcgctggtggagtctgctaaggctttgaagggtttgatcgaccagagtggtggtggcgcgggtgtgcgccgtcttgcggggagtgcccccgttgatgatgttaaacgacgtgagggtgtcgcgtttgtggatgctcttgtcaataattctaggagatgatttctgatggctgacgattttctttctgcagggaagcttgagcttcctggttctatgattggtgcggttcgtgaccgtgctatcgattctggtgttttggcgaaactgtcgccggagcagccgactatttttggcccggtgaagggtgccgtgtttagtggtgttcctcgcgctaagattgttggtgagggcgaggttaagccttccgcttcggttgatgtttcggcgtttactgcgcagcctatcaaggttgtgactcagcagcgtgtctcggacgagtttatgtgggctgatgctgattaccgtctgggtgttttgcaggatctgatttctcccgctcttggtgcttctattggtcgcgccgtggatctgattgctttccatggtgttgatccggctacgggtaagcctgctgcggctgtcaaggtgtcgctggataagacgaagaagacggttgatgccaccgattccgctacgactgatcttgttaaggctgtcggcttgattgcgggtgccggtttgcaggttcctaacggggtcgccctggatccggcgttctcgtttgctctgtctaccgaggtgtatccgaaggggtctccgcttgccggtcagcctatgtatcctgccgccgggtttgccggtttggataattggcgtgggctgaatgttggtgcttcttcgactgtttcgggtgccccggagatgtcgcctgcctctggtgttaaggctattgttggtgatttctcgcgtgttcattggggtttccagcgcaatttcccgatcgagctgatcgagtatggtgatccggatcagactgggcgtgacctgaagggccataatgaggttatggttcgcgccgaggctgtgctgtatgtggctatcgagtcgcttgattcgtttgctgttgtgaaggagaaggctgcaccgactcctcctccggccccgaagcctgagcctaatcctccgtctggtaactgatacaagataagcgaatgtgtactatgtgcagggggtggtgttgatgggtatcattttgaagcctgaggatattgagcctttcgccgatattcctagagagaagcttgaggcgatgattgccgatgtggaggctgtggctgtcagtgtcgccccctgtatcgctaaaccggatttcaaatacaaggatgccgctaaggctattctgcgcagggctttgttgcgctggaatgataccggggtttcgggtcaggtgcagtatgagtctgcgggtcctttcgctcagactacacggtctaatactcccacgaatttgttgtggccttctgagattgccgcgttgaagaagctgtgtgagggtgatggtggggctggtaaagcgttcactatcacacccactattaatggtcgatatgtgcattctgaggtgtgttccacggtgtggggtgagggttgctcgtgcggatctgatattaacggctacgctggccctttgtgggagatatgatatgaccagttttccttatggtgaaacggttgtgatgcttcagccgactgttcgtgtcgatgatcttggcgacaaggtggaagactggtctaagcctgtcgagactgtgtaccataacgtggccgtttatgcttccgtttcgcaggaggatgaggcggctgggcgtgactctgactatgagcattggtcgatgctttttaagcagtctgttgtgggtgccggttatcgttgccggtggcgtattcggggtgttgtgtgggaggctgacgggtctcctatcgtgtggcatcacccgatgtctggctgggatgcgggcacgcagatcaatgtgaagcgtaagaagggctgatagattgtggctcaggatgtgaatgtgaagctgaacttgccgggtattcgtgaggtgttgaagtcttttggggtgcaggctatgttggctgagcgtggcgagcgtgtcaagcgtgcagcctcggcgaatgtgggcggtaacgctttcgataaggcccagtatcgtgcagggttatcatcggaggtgcaggttcaccgtgttgaggctgtggcccgtattggcaccacatataagggtgggaagcgtattgaggcgaagcatggcacgctggctcgttcgattggggctgcgtcgtgattgtttacggtgaccccaggaagtgggctaaacgcgtgctcaaggatgatggctggctgtctgggataccgtgtacagggacggtgcccgatgattttacgggtgatctgatttggttggctcttgatggtggcccgcagttgcatgttcgtgagcgtgtttttttgcgggtgaatgtgttttctgatatgccggatcgtgctatgtctttggctcgtcgtgttgaggctgtgctggctgatggtgtggacggtgaccctgtggtgtactgtaggcgttctactggacctgatttgctggttgatggtgcacgttttgatgtgtattcgctttttgagcttatatgtaggcctgcggagtctgaataagcttattgtttttgttttaatgtaattgtttgatatttaatgggggttatgatggctgcaacacgtaaagcgtctaatgttcgctctgctgttacgggtgacgtctatattggtaacgctcatgccggtgacactattgatggtgtgaagacggttcctgacggtcttaccgctttagggtacctgtcggatgacgggtttaagattaagcctgagcgtaaaacggatgatttgaaggcttggcagaatgcggatgttgttcgcactgtggctacagagtcgtctatcgagatctctttccagctgatcgagtctaagaaggaggttatcgaactgttttggcagtcgaaggttactgccggagccgattctggttcgttcgatatttctcctggtgccaccactggcgtgcacgccctgttgatggatattattgatggcgatcaggttattcgctactatttccctgaggtcgagttgatcgatcgtgacgagatcaagggcaagaatggcgaggtgtatgggtatggtgtgacgttgaaggcgtatcctgcccagattaataagaagggtgatgcggtgtctggtcgggggtggatgacggctttaaaagctgatactcccccggttcctccttctccgaagccggagcctcctaagcctgagccggatccgaatccgccgtctaataactgatacacatagtttgagggattgttgatagatgagtgacacaggttacacgttgaagattggtgaccgtagctgggtgttggcggatgcggaggaaacagcgcaggctgttcctgcccgcgtttttcgccgtgccgccaggattgcccagtctggggagtctgctgatttcgcccaggttgaggtgatgttttccatgttggaggctgccgccccagaggatgctgtggaggccttggaggggcttcctatggttcgtgtggccgagattttccgtgagtggatggaatataagcctgacggtaagggtgcctcgctgggggaatagtttggctccacggcctgattgatgattatcgtggggccatcgaatacgatttccgcaccaagtttggtgtttctgtttatagtgttggtggcccgcagatgtgttggggtgaggctgtccggctggctggcgtgttgtgtaccgatacgtctagccagttggcggcccacctgaatggttggcagcgcccgtttgagtggtgcgagtgggctgtgctggacatgctggatcattacaggtctgctaatagtgaggggcagccggagcctgtggcgaggcctacggatgagcgtagggcccggtttacgtctgggcaggtggacgatattttggcgcgtgttcgtgccggtggcggggtgtctcgcgagattaatattatggggtgaatagtgtatgtctggtgagattgcttccgcatatgtgtcgttgtatacgaagatgcctggccttaaaagtgatgttggtaaacagttgtcgggtgtgatgcctgctgagggtcagcgttcgggtagcttgtttgctggcgggatgaagttggcgcttggtggtgcggcgatgatgggtgccatcaatgttgctaagaagggcctcaagtctatctatgatgtgactattggtggcggtatagctagggcgatggctattgatgaggctcaggctaaactgactggtttgggtcatacgtcgtctgacacgtcttcgattatgaattcggctattgaggctgtgactggtacgtcgtatgcgttgggtgatgcggcgtctacggctgcggcgttgtctgcttcgggtgtgcagtctggcgggcagatgacggatgtgttgaagactatcgccgatgtgtcttatatttcgggtaagtcgtttcaggatacgggcgctatttttacgtctgtgatggctcgcggtaagttgcagggcgatgacatgttgcagcttacgatggcgggtgttcctgtgctgtctctgttggctaggcagacgggtaaaacgtctgctgaggtgtcgcagatggtgtcgaaggggcagattgattttaacacgtttgcggctgcgatgaagcttggcatgggtggtgctgcgcaggcgtctggtaagacgtttgagggcgctatgaagaatgttaagagcgccctgggctatcttggtgctacggctatggccccgtttttgaacggcctgcggcagatttttgttgcgttgaatccggttattaagtctatcacggagtctgtgaagcctttgtttgcgtcggtggatcaggggattcagcggatgatgccgtctattttggcgtggattaaccggatgccggctatgatcacaagaatgaatgcacagatgcgcgccaaggtggagcagttgaagggcatttttgcgagaatgcatttgcctgtccctaaagtgaatttggctgccatgtttgctggcggcaccgcagtgttcggtcttgtggctgccggtgtggggaagcttgttgcggggtttgccccgctggcggtgtcgttgaagaatctactgccgtcgtttggtgctttgaagggtgccgctggggggcttggcggcgtgtttcgcgccctgggtggccctgtcggtattgtgatcggcttgtttgcggcaatgtttgctacgaacgcccagttccgtgccgcggtgatgcagcttgtggctgtggttggccaggctttggggcagattatggccgctgtgcagcctgtgtttggtctaattgctggtttggtggcacggttggctcccgtttttggccagattatcggtatggttgccgggttggctgcgcagcttatgcctgtgattagtatgcttgtcgcccggctggttcctgttatcacgcagattattggtgcggtgacgcaggttgctgcaatgttgttgccggcgttgatgccggtgttgcaggctgttgttgctgtgatacggcaggttgttggcgtggtcatgcagttggtgcctgttttgatgcctgtgattcagcagattttgggtgctgtcatgtctgtgctgccacctattattggtcttatccggtcgttgatgcctgtgattgcggcggttatgcgtgtggtggttcaggttgttgcggttgtgatacaggtggtggcccgtattcttgctgttgtggctccgatggtggcggccgtggtcgggtttgttgcccgtattgttggtgctgtcgtgtcggctgtggcccgtgttattgccgctgttgcccgtgtcatctcgtgggttgttgcccattttgtgtctggtttggcgcgtatgggttcggtggttcaggctggctggaatcatattagggcgtttacgtctgcgtttattaacggtttcaagtcggtgatttctggcggcgtgaacgcggttgtggggttttttgcccggcttggttcttcggttgcctcccatgtgaggtctggttttaacgcggctcgtggcgctgtttcttctgcgatgaatgctatccggagtgttgtgtcttcggtggcgtctgctgttggcgggtttttcagttcgatggcgtctagggttcgtagtggtgctgtgcgcgggtttaatggtgcccgtagtgcggcttcttctgctatgcacgctatgggctcggctgtgtctagtggtgtgcatagtgtgatagggtttttccggaatctgcccagcaatattaggggcgctttgggtagtatggggtccctgttgatgtctgctggccgtgacgtggtggccggtttgggtaatggtattaagaatgctatgagtggcctgttggatacggtgcgtaatatgggttctcaggttgctaatgcggcgaagtcggtgttgggtattcattccccgtctcgggtgtttcgtgacgaggttggccggcaggttgttgctggtttggctgagggtattactggtaatgctggtttggcgttggatgcgatgtcgggtgttgcttcgcagcttccggatgctgtggatgcccggtttggtgtgcgatcgtctgtgggctcgtttaccccgtacgaccggtatcggcgtgctcagggtgagagtgttgtggtgaatgtgaatggcccgacgtatggtgatccggccgagtttgcgaagcggattgagcggcagcagcgtgacgctttgaacgcgttggcttacatgtgagtaaaggggtatgcatgtttattcctgacccgtctgatcgttctggtttgactgtgacatggtcgatggatccgcggtttggcgacgagcgtgtgcttcatttgacggattatacggggtcgtctcctgtcatgttgttgaatgattcgttgcgcggtttgggtgttcctgaggtggagcatttttctcaaacgcatgttggggtgcacggttcggagtggcgcgggtttaatgtgaagcctcgcgaggtgacgctgccggtgttggtgtcgggtgttgacccggatccggtgggcgggtttcgtgacggttttttgaaagcctatgacgagttgtggtctgcgtttcctcctggcgaggagggggagttgtctgtgcagactcctgccggtcgtgagcgtgtgttgaagtgccggtttgattcggtggatgacacgtttacggttgatccggtgaatcgcggctatgcccgctatgtgattcatttgacggcctatgacccgttttggtatggggatgagcagaagtttcgttttagtaacgctaagttgcaggattggctgggtggcggccctgtcggcaaggatggcacggcgtttcctgtggtgttaacaccgggtgtgggctcgggttgggataatctgtctaataagggtgatgtgcctgcgtggcctgtgattcgtgttgagggcccgttggagtcgtggtctgtgcagattgatggtttgcgtgtgtcttcggattatcctgtcgaggagtatgattggatcactattgatacggatcctcgccagcagtcggcgttgttgaacgggtttgaggatgtgatggatcgtttgacagagtgggagtttgcgcctatcccgcctggcggttcgaagagtgtgaatattgagatggttggtttgggtgccattgttgtgtcggtgcagtacaggtttttgagggcttggtgaatggttgatggctggtcttgttccgcatgtaacgttgtttacgccggattatcgccgtgtggcgcctatcaatttttttgagtcgttgaaactgtcgttgaagtggaatggtttgtccactttggagttggtggtgtcgggtgatcattctaggcttgacgggttgactaggccgggtgcacggctggttgttgattatggtggtggccagattttttctgggcctgtgcgtcgggttcatggtgtgggtccttggcagtcttcgcgggtgactatcacgtgtgaggatgatatccgcatgttgtggcgtatgctgttgtggcctgtgccttatcgttccagcatcattgggatggagtggcgtgccaatagggattatgcccactattcgggtgcggcggagtcggtcgctaagaaggcgttgagggataattcttggcgttttccgcctgatatatttatggtgaatgataagagtcgtggccgctatattaaggattttcaggcgcggtttcacgtgtttgccgataagttgttgccggtgttgtcgtgggctcggatgactgtcacggtgaaacagtttgagaatgtgaagcaggatcagcgtggtttactgtttgattgtgtgcctgctgtgacgcgtgagcatgtgttgactgccgagtctgggtctattgtgtcgtgggagtatgtgcgtgacgccccgaaggctacggcggtggttgtgggtggccgcggcgaaggcaaagatcgtctgttttgtgaggattttgacgcgttggccgaggatgagtggtttgatcgtgtcgaggtgtttaaggatgcccgtaacacggattctgagcatgtgcatctcattgatgaggcggagctggtgttgtccgagtcgggggccacgtcggggtttaagatcgagttggctgagtcggatgtgttgcggtttgggccaggcaatctgatgccgggtgatttgatctatgtggatgtgggctcggggcctattgcggagattgttcggcagattgatgtggagtgtgtatcgcctggtgacgggtggacgaaggtgactcctattgcgggggattatgaggataatccgtcggccctgttggctcgccgtgtggctgatttggctgcgggtgtgcgggatttgcaaaaattttagaaaagaatcgggggtttgttgtgggtattgtgtgcaagggttttgatggtgtgttgaccgagtatgattgggctcaaatgtctggtctgatgggtaatatgccgtctgtgaagggcccggacgattttcgtgtcggcactactgttcagggtgccacagtgttgtgtgaggtgttgccggggcaggcttgggctcacggggtgatgtgcacgtcgaatagtgttgagacggtgacagggcagctgcctggtcctggcgagacccgatacgactatgttgtcctgtctcgggattgggagcagaatacggccaagttggagattgttcctggggggcgtgcggagcgtgccagggatgtgttgagggctgagcctggcgtgtaccatcagcagttgttggcgactttggtgttgtcgtctaacgggttgcagcagcagttggataggcgtgctgtggcggcccgtgtggcgtttggggagtctgctgcgtgtgaccctacccctgtggagggtgaccgggtgatggtgccttcgggggctgtgtgggctaaccatgctaacgagtggatgctgttgtccccgcgtatcgagacgggttcgaagcagatccagtttggcgggtctgctgtgtatgcttacacgatcccgtttggccgcccgtttggtagtgcgcctgtggtggtggcgtctatggcgacggcggctggtggtacgcagcagattgatgtgaaagcctacaatgttactagcaagtattttcagttggcgtttatcacgaatgatggttctaagccttctgatgtgcctgcggttgctaactggattgctgtcggcgtgtaatgtacggcttgcgggtatgtgacgtgttgtggttgttgtagtggtagggggctgtagtgtcatggcttacacccacactcgtagcctctctttgtaccgctatcgctactgttcttggttcgattcaggcggctacgtacaggtcgaagaagaggctgaggcagttgtctgcgcaggttgatgcgatggaagaatacacgtggaatattcgccatactgttcaccgctataatgcgaatctgccggagaatgttgagccggtaaagatgcctgatttgcccgagtttttgaaggatactgttgatggtggtggggggtgaattgtgagggagttggaggaagagaagcggcagcgccgctcgtttgagaaggcttccatgatactgttgttcctgtcgcttgtactactggcggtggtcgccgggggtgctttacgtttcggtgctgtggcttcccagcgggattcggagcaggctaaagcccagtctaatggtacagccgctaaagggttggctagccgtgtgcggcaggtgtgtgcctctggcgggcaggagtcggtgcggcttcaccagtctggcttgtgtgtggatgctcagcgtgttgagcgtagcgtgcagggtgtgcctggtcctgccggtgtgcgtggcccgcaagggcctgcaggggttgacggccgggatggtgttgatggttcggctgggctggttggccctgttggcccgcagggttcccctggtttgaatggtgtgaagggtcctgacgggctgcccggtgctaacggttcggatggccgtgatggtgttgccggtgtgaacggggctgatggcaaggatggtgtgccaggtagggatggcgctgatggggctgatggtggccgcggccctgttgggcctcaggggccgcagggttctgccggtgccgatggcaaggacggtaaggatggcgctgatgggcgctcggtgatatcggtgtactgttccgggggccgcctggttgtgaaatatagtgacggtacggcctctaccatagcgggttcggtggcctgtgagggtgtgaaaccatcaccggtggttaccgtatcatcccacaagtaaaagaggaagtgtgttactagtgttgatagtagtgtttgggggtggcgtgttgtgagatacattccagcggcgcatcactcggccggatcaaataagccggtgaaccgtgttgtgattcacgcgacatgcccggatgtggggtttccgtccgcttcccgtaaggggcgggcggtgtctacagcaaactattttgcttccccatcgtcgggtggttctgcccattatgtgtgtgatgttggggagacggtgcagtgcttgtcggagtctacgattggttggcatgccccgccgaatccgcattctttgggtatagagatttgcgcggatgggggttcgcacgcctcgttccgtgtgccagggcatgcttacacgagggagcagtggctggatcctcgggtgtggcccgccgtggagcgtgccgccatcctgtgtcggcagttgtgtgacaagcatggtgttccgaaaaggaagcttagcgtatccgatttgaaggccggtaaacgtggtgtttgcgggcatgcggatgttacggatgcgtggcatcagtcggatcatgacgatccggggccgtggtttccgtgggacaggtttatggccgtagtctgcggcggtagtggagagagtgaggagttaactgtggctgatgtgaaagccttgcatgatcagattaaacaattgtctgctcagcttagtggttcggtgaataagctgcaccatgatgttggtgtggttcaggtacagaatggtgatttgggtaagcgtgttgacgccctgtcgtgggtgaagaatccggtgacggggaagctgtggcgcaccaaggatgctttgtggagtgtctggtattacgtgttggagtgtcgtagccgtcttgacaggcttgagtctgctgttaacggtttgaaaaagtgatggtggtttgttgtgggtaaacagttttggttaggtttactggagcgggcggctaagacttttgtgcaaacgtttgttgctgtgttgggggtgacggcgggtgtcacctatacggcggagtcgtttcgcggtttgccgtgggagtcggccctgataacagctacggtggctgcggtgttgtcggtggctacatcgtttggtagcccgtcgtttgtggccggcaagcccggcaagcctcagctggatgcgggtttggttccaccggatgatcccggaatagtggagcctcattcggtggatgtgtcggatcctggcatgatcgagccgatggatgaggctgatgttgccggctatgtgccgaagcgtgccgccgagtcggaggttggcacggtagagtctactgttgcataagtgaatatagatgtgtgccccagcggtgctgccacgatcgtgtggtggttgccgctggggcactatttttgtgtctatagtattctatgattcgttgctgtcgatggtttcttcgatcagctggtccaggtggatgcaggcggagatagtatcgttggcctggtgcagaacgttctggccgataacatttttataattgtcgcggtggcagatgatagactgcatgatatcgtcggcttccgcttgcaatagtttggcctggtatgcgattccggcgagccaatctatggcttcctggcttgcccgtgtgtcgtctggaatgccacgggtgttgctgttgtttgggtatcctgcactgtcgcagtcccacaagatttcgctgcactcgtctagcgtgtcctgatcgatagcgagatcgtcgaggctgacttctttgacggtaaggttcacgttgtcgagtgagatgggtacacggtactggttttcgacaccgtcaacaatgttttccaattgctgcatgttggtgggctgttgttggatgattcggtgtactactgttttgagggcggtgtaggggatattgtgtgtgttgtccatcgtgttatgccattccttcgttatcgtctggcatgtagtatgtgctgtttgcgtactcggttaacgtcatcagtgtttggtctgcccactgtttcacggtttgccgggtgactccgagtcgttgggctgccaccgaataggtttggtcatacccgtagacttcccggaacgctgccaacctagctagccgtttcctttgtttggatggctggcaggtgagggtgtagtcgtcgatggctagttgtagatcgatcatggtgacaatgttgttgccgtggtgttgtggcgcggtgggtggtggtggcattcctggttcaacactcggtttccatggtccgccgttccagatccattgcgcggcttggataatatcggctgtggtgtaggtccggttcatgtgtcatcccctgaataggttgtcgaggttgtctgggttgctggtgtcgaatcgtccgacgcagtggcagtagtcgtacatgagtttgatgatgtgttggtggtctcccaaataggtgtttccgctgatgctgtaggtggctgtgccgtctttactaatagtgtatttggcggtgatggtttcgggtgtttcggtgttggtgatgatggcggtggtggtggcgcctactgtttgtagcctggtggtttgggtgccgtcgtcgaggatggtggtgaccattatgattctccttagttgctggtttggttgtcggctagatgaataatatcggataaaggtttcggctggtctaaatgttgtgtggttttgttggctagccgtttggctaccctgtagcacattttggtgtagtgtttgttgtctaggttgtggtattgttcccgcaccgcaatatatagtagggagtcttggtagaggtcgtctgcgctgattgcggggtagtgtgtaaccactttggtgcatgcccggttgagtgtgcgtagatgatggtctgtggcccatccccacgatgcggtggtggctaggtctgcttttgttggtcgcctgctcatggcactattacctggctatctggtagttgtttggtgttttgttgttgatagtgtagcacacgagtccggggtttccggtggtgcccgtcttgtgccggaaccatgtggattcgccttccatggatgggcattggatgaaggtgcgtgtgccttgctcagagatttctaggtggtgccggtgcccggccatcaggatgtgggatgtggtgccgttgtggaattcttggccgcgccaccattcgtagtgtttgccggtgcgccattggtgcccgtgggcgtgcaggatttgtgtgcctgccacatcgacggtggtggtcatttcgtctcggctggggaagtggaagtgaaggttggggtattggttgttgagctggtaggcttctgcgatggcgcggcagcagtccacgtcgaaggagtcgtcgtaggtggtgactccttttccgaagcgtacggcttctccgtggttgccggggatggatgtgatggtgacgttggcgcagtggtcgaattggtggatgagttgcatcatggccatgcgggtgagccggatttgttccgtcaggggtgtttgtgtgcgccaggcgttgttgcctccttgtgacacgtatccttcgatcatgtcgccgaggaaggcgatgtggactcgttgcggtttgcctgcttgctgccagtagtgttttgcgacgatgagggtgtgtaggtagttgtcggcgaagtgtgctgtttctccgccggggatgcctttgccgatttggaagtctcctgccccgatgatgaaggctgcagtgctgtagtcggtgtgggtgtcttgttcgggttttggtggctgccattcggctagtttatcgacgagttcgtctatagggtaggggttggttgcgggttggtggtcgatgattttttgtatggatcggcctgtttctccgttggggagtgtccattcggagatgcgtgtgcggcgcacggtgccgttggctagattgtcgtcgatggtgtcgatggcgttgtcgtggttggctagctgtgtgaggagccggtctatgttgtctatcactgggtatcatcctcttcctcgtgtgtggtggtggcttgtttgcggcgatggtctttgataacggtggcggagatggggtatccggcttcagtgagcatttgggctagctgtgtggcggggatggacctgtcggcgaggacgtctgcggctttgttgccgtagcgttggatgagggtttcagttttggttgccatgatgtcctatcggttgtgtggtgggttgccatcctgtgcggcagtcgccgtcgtgtcctggtttgcgtgtgcaccatgagacttcgccggcattgtggatgatggcacggccgcatatgacgtcatgtaggtgttcgggaaacttatcgttgttgttgtccccgtacatgtcgatcaagtgttgggttttagtaaccatcatgtctcctatgtgtgaaagagtgtgcaaatactatgctggtgtcatggatgtttatgcgggtatggttttcatcaccttgctgaacgttacttggttactgtacatcatctgggtgatttcctgatccgttttgtcggggtgctgttttcgcaggtttgcccattggcaggcgttgtcggtttcctgctgtaaacgtgtcaggtgttgttcgttgatgatgtgtttccacattgtccacgagacgtcgagtcgtttgagcatgtcgatggctggcacgttgaaggagttgaggaagagtatttcctccgtgtagtagtctttttcgtattggtcccatccgcttcggtgcctgttgggctggtttttagggtaggcttcccggcatactttgtgcaaacgcttggccatgtctttgggtagcctaatgtcggggttggcgcggatcatggatcgcatcccatcataggtggtgccccaggtgtgcatgatgtggagtgggtcttcaccatcagcccatttttctgcacagatggcgaggcggatacgcctccgggcggctttgctagtgtcgcggcggccggggatggggcatgtgtcgagggggtccatgatgctttttatgcctttctttgtttggtttgcttgtgtggttttattgtagcactgtgtctagtgcttgtgtcaaccctgtttttccggcctgcaggtaggtgtctgtgacatcgcccagggtgaggggcacgcgggtggcttgggggagtgccgtctggagggtttgggccatctggtctcctgctttgtcggggtctgaccagatgtagatgtggtcgtagccttcgaagaatttggtccaaaagttttgccacgaggttgcgccgggtagggctacggccggccatccgcattgttcgaggatcatggagtcgaattcgccttcgcaaatgtgcatttcggctgccgggttggccatggcggccatgttgtagatggagcctgtgtcccctgccggggttagatatttggggtggttgtgggttttgcaatcatgctggagtgagcagcggaaacgcatttttcgtatttcggctgggccgtcccagacggggtacatgtaggggatggtgatgcactggttgtagtcttcgtggcctgggatggggtcattgtcgatgtatccaaggtggtggtagcgggctgtttcttcgctgatgcctcttgccgagagcaggtcgagtatgttttcgaggtgggtttcgtagcgggctgaggctttctggattcggcggcgttccgcaatgttgtagggttgtagtgagtcgtacattcgggttttctttctctaattgttgtttcagtttggcgaggcctcctccgatgccgcatgtgtggcagtaccagacgcccttgtcgaggttgatgctcatggagggctggtggtcgtcgtggaacgggcagaggatgtgttgctcgttcctggatggattgtaccgtatctggtaggtgttgaggaggcggcaggtgtcagaggtgtgggaggagctcgttgagggttgataccacataggcttcgctccatggcttgttgcgctgtttcatcactacgagtccgatggtggaattgttttctcggtttcggtgggtttcgtagttgcgtgcctcccggctggcttgtttcacgaattcggcgaggtgtgcctgtcctgctttggcttcgatcacataggttttgtggccggttgtgaggatgaggtcgccttcatcctctttaccgttgaggtggaggcgttctatatcatagccggtgtcgcgtagctggtggaggagtcgtgtttcccattcggctccggcccggcggttgcgtgcctgttgtgttgacatgatagtcctttgtggtgttcggtcatgttccatggctgtttttcggcgagtggcccgaagaatgtgtattcggggtaggctcgcagtcgttcgtatcgggtgccgtctgggctggatttgcctgtgcgctgtttgagtacggcgatgcgtgcctctgccggtatcgtgagcccgttgccgttatcttcgccaccatacagggagactcccaatatgagttgtggtttttcggagaggccgtttttgatttcccgcctagccggggggtgttcgatgtcggtgccggttttgtcggttgcgtggtgtgtgacaataatggtggagccagtatccctacccaatgctgtgatccattgcatggcttcttgctgtgcctggtagtcggattcgcagtcttggatgtccatcaggttgtcgatcacaatgagtggtgggaaggtgttccacatttccatgtaggcttgcagttccatggtgatgtctgtccatgtgatgggtgactggaatgagaatgtgatgtgttggccgtggtggatgctgtctcgatagtattctggcccgtagtcgtcgatgttttgttgtatctgggcggtggtgtgttgagtgttgagtgagatgattcgtgtggaggcctcccagggtgtcatgtcccctgatatgtagagtgcgggctggttgagcatcgctgtgatgaacatggctagcccggatttttggctgccggaccgccccgcgatcatgacgagatcccctttgtgaatgtgcatgtccaggttgcggtagaggggttctagttgtggtatgcggggcagttcggctgcggtttgggaggctctctcgaaggatctttggagagagagcatcggagccttaatctatctgtctatcggttggatgatgttttggtggtcagatggagtcgatgtcgatgtcagcatcagcaggggctgtggtgtcgtctagctggccgttatcgcgtttgtctacgtattcggcaaccttatcgtagatggcgtcgtctaatggtttgagcacgaccgcgttgaacccgtttttggtgcgcacggtggcgagtttgaatgcctgttcttcgccaaggtaggcttctaggtcgcggatcatggagtgtgggcggtcgttgttgccgcgggctttctcgataatggcgttggggatggtttctggggtgccgttgttgagatcgtctagggtgtggaagattgtgacatcagcgtagatgcgatcggcgacctgtccaccgtagccttcggtgttgtgctggacgtcgcggattttgaaggcgatggcggtggcgtcctggtttcgggaggggttgaagaaggtgctgttgctgttgttgcggtagtttgcgagtcccattgttgtttcctttactgttttgttggtttgtttgttggttttatcgggtgaggctgtttcgtttgctgcggaaagcctcggaaacgtcactgttactggtgatgatctttttgtactgtttgaggaggtcggctagctgtgctttgcttgttgcattgttgattttgtcgatgatggtgttgtttccttctgaggcgatgttgtctacgtagtctttggcggcctggttgtatcggtcttggaggattatggatgctgtggcgatcagtgttgccaggtcccagttccttgccgcggagctgtttttgagtccgccgaggaggtcgatgatagtcttctttacctggtcggcggtgtctccgcggatgacggtccatggggcggcgtagtcgcctccgtatttgagggtgacggtgaatcggtcgtcgtctgtgttgtcggtcactggtgctccttgtcttcttttgttggggctgtgatggtggtttctatggggtacctgtaggcgtctttcccgttgacagcccagcaggcgtccttgacggggcagcctttacagagtgctgtgacgtggggtacgaagatgccttggctgattcctttcattgcttgactgtacatggatgatacatgccggtaggtgttgttgtcaaggtcatagagttcggttgctgtgccttgtgtcggagactggtcgtcgttgcggctggtggctggcgtccaaaacatgcctttcgtcacatcgttgccgtgttggttgagcatgtaccggtatgtgtgcagctgcatactgtcggcgggtaggcgtccggttttgaggtccaaaatgaaggtttcaccggtgtcagtgtcggtgaaaacgcggtcgatgtagccgacaatagtggtgccatcctggagggtggtttctaccgggtattcgatgcccggctggccgtcaataacagcggtgatgtattctgggtggttgcgcctccatgttttccaccggttgacgaaggtggggccgtatatcatccaccaattgtagtcttttttgtgtggcccgcccgattcgcacatgtttttgcatattcggccggagggtttgatgtttgtgccttctgatttggcgagggcgacttgggtgtcgaaaatgtttttgaaggatgagagtttgtctggcagtgcagggtattcggcgggattgtacaggtgtaggtcgtattgttcggtgatgtggtgtatggcgcttccggcgatggtggcgtaccaggtgtggtgttgggtgtggtagccgtgggataggcgccatttttctccgcattcggcccactgggtgagtgaactgtaggagatgtggcctggatgatcaatggtggacggtttttgtgctagaggcattacttgtcgcctttgtgggtgttccatgggttacgggtgtcttggccggcgtggtgttgctggtatgcgaggagtgcgaggcagtgccaggcagcatgggctagatggggtagcccggattcatcatcgaggttgtttccttgctgccatgatagcaggtgcctgtagagggcgtcgacgctgtggctccacggatagccgccggtccagttgttgtcgccgtatttggtggcaccgtatcctgccacggagccgagggcgtgcaaggctgcggggtcgatgagggatagcctgcaaagtttcaattcttttttggcaccgctgttggggtcggtgtacatgcgggttggcttatccatgagatgtgtgctccttaggggtgggttactggttggggttgtgggcgagtgctacggcgagaataatgatggcgagggtttcagcgatcagtatgggtgttgtgatcatttagtgtttcggggattgttggtgagtgtggaggcgcctaggagggtggtgagggcgcatgcggcgatgatggcgagggctgccttgtgtggggtgccggttgcgtacatccatgtgatgatgccgccttggatccatgccagtgtggtgaagaaagtttcgtagctgtgtagctcaatgttgttgttgggtgtgttcatgcttgctcctgaagaatggtgttgatggttttgtaaatgttgtacaggtcggcttcgatggtttgtagctgtttgatttggtggtcgagatcaatgtctgggttgagggtgttgatgcgggaggcgatgtcggtggctgtgcgtagtgtgccgccggtgtggtgaatgatgtgtgccgtgtcggcgagtccggtggtgacggcgtagtgggagaggagaggcatagctggggggtgctccttggcgggttactgttgcgggttgatgttgaggtcggtgacgtgcgggtggtcttctgttccggtgacgaggcagtggacggtgacgggtagtttggatgctccgggctgtttcatggttgcgccgtagacgatggagaaggtgtctttgccaataattttgtggagttggaggtcgatgtcggggttgccgttccatttgacaccttgcgtggcggccttctgttcggctttgcggttgcaggtgtgtgcggcggtgatcatggtgagaccttgtgaggtttcttcaccccttgcctgggcttgcttgtgggttttggcctgctcggctcgcagtgactgttctgcggctgcctgccgtgccgctttctcggctttgcgctgttgggtggttttgggggtccattcggtgttggctgtggtggcctgtggggctggctgtgaggcgagtggcggattgtcgtctggggctggcatgaatgaggcggcggcgatgatggcggctgtgattccggcgatggtgtagcctgttttcttgttcatgactgttgtcccctttccggggtgttgttcgttgctgacatgatcaatcatggtgtgggcggttccccatgtcaaggctgcgctcaacgattgtgagcgatccttgtgtggctaggggtgatggcttctttcgcccaataggatgtgccaccgctggtccagtatccgagtttgttgcgctgcatgcccttcgcctccatctcgtccacggtgaggcacctgcggcgattggggcctgtcttgaccccgtggtcgcctacccggtgcatgtcgcctgaggtggtactcgtgaatgtctcgtgacagactgtgcagtgctctggcttgtatccgatgattgtgctatcgcacttgtggcatgtccattgcatgattgctcctattttccattataagacttcctgtagtgccattttagcgccttgcgagtcttgggggtacaactatataggtcaggtatttctaggcgattctaggctcattgtgtgcgactgggtgttatcgggcacacagggtgagcaggcttccgatgttgatgcggctcacattccagtagagttgtgtggcttcaccgccggtgagtggcttccactcgtcatggctgaacacggtgccatcggatgcgatgaatgtgttggggcgtagcttgtggagttcagtctctacgctctgccggtaggcttcggcgaggccctcaaaatccatgtggtcgcaggagaggttttcgaggcgtgtcaggtcgaaaggctcagggcagtccggggtgggggtgtaaagctgggtgaagtggttggcgatcttctgcatgacgggttccttttctcgtgtggtgggttgatagttttatcgtgtggcttcggcaatgatggcgtccacatcgatcatgtcgatgagatcgttgagttcctcggcctcgttctcggagaggtggcgccagtcgggtggcccgtatacggcaccgtcgagggtgacagtccacaggggccggatgagccgtacggcttcctcgactttggcacggtataggcggcagatgatagacgtgtgggtgttgcctatgtcacatcctgccaggtgtgcggggtggagtgggtggatttctgtctgcccgtagaggctggtgaaggatggtgtgatgagtgtgccatccatgagggtgtgctcctttcggtggtgtatgggttgttgtggtttctagagtgtgtagatggcgatcccatagtcaaggctgcgctcatttggattgagcgtttcatgggatgtggcaggggatgtggcgtatctcacttaagcctttatggcctctctcagcgcctgaaatcttctggcggtaggattatgcagggttgaccctgctaatcgattctaggggccttctagagcgtctcaggggtatgtctgggtgatagcgggtgtggcagatgatctagcgagtcaaggtgccgagctgagacataagatctatcatctaggtgtgtgagatgcatcacatcctcctggcgtggtgtacacccttaaggctactcggtcgatctggcgtggagggtgtagcccagaaatgccgtttaaagctgtgactcggtggattagagcgccttacagggtgggggctaggtatttatacccccaagcaattctgatcgattctagacgcctacaggagcccgatacacgatcagctatccagacgcagatcaccagtccctatcctggttagctcagcctacactatgtggacagtgtggaatactgtaggggaagaaggacacggtaaaagaaagagggaggcatcagccttcaagccttaaggtcttagcgcttagcaccgatggtcttagcagttagcaccgagcccctcaagggctcggcatcagcccgaacaggcacagccctgaaaggagtacacgccatcagggaaggcttgagagtacgaggagccctagcgacgagtactcgaaagcctgagggaacaccctcagcactgatgggcctagcgtgttcggaaaggacacaagagtgaagtgtgagagctgttcgggagtgaaacctgttctgactaggggtttcggtcttaaccaccctcaaaggttacaagactctaagaaaatttaaggaaaagtttaggtttaatttttggacctttactaccaaaaacacccgtttacacccctcaaacccgcctatagagccaaaaccaccagtttgactcatcccaggtggcatatgataggctggacaggtagccagctggacgcaaggccgaaatccgctgacgcggctttcacccttacatccatcagtctaccaaacactttaaagcttcaaggcttagcgctaagcccttaagaccttaacgcttagcaccgagcccctcaagggctcggcatcagtcttaaagctttaaacactttaagtaaacttaagagcttagcacttaaagttaattaataaccttaaaggcttagcacttaaggatataaacttaacatcagtgtttaagactttaaaacttaaaataactattaagacttaaagacttataagctttaaacacttaaagtaactataagactttaaagaccttaagtacttaaagttaaccatcagtcttaaactttaatattataacctataagtcttaaagcttataggtataataatataatataagttataaaagttttagaagagctaaggggttaacttctttacttctctactctctttggttctttctctcttctcttcttttcttcatcaggggagaagaggaacctttaccatcaacgctgatgggctttcaccgtgtgactcgtgtgcttctggtcgcacgctcccggttgcacactcaccacacttactctacctgtgtccctttcaggcttagcgtgttcggctgaaggcgtacggcgtgtcacgctaacacccttaacaccaggtaagacttaaagtgtatattataagtagaagactttaaaaccttaaggtgttcccgcttagcctgtgtcctttagcgctaggcgctaggcgctaagctgtgaaacgcgaacacccatccacccccttttttcttccgtgtccttcttcttttgacaccgctggggggcgatgtgatctttctcacactcatggggggtagtggagaaaacaaccaccccggcacaaacagaacaccccctcaaacgaacaaaacagcccctaggatcgatcagcagggcaagggcaaggtattcatacccccagacgattcccaggccgttacaggagcaatgagaggctcacaggggcaaggggagatcaggggacgtgatggcacataccaaccgcaccgcatccgcctcacaccggcgctggcggcaacgactcatcacccaagcccaacaacaaggccaaaccgaatgcccactctgcggagcaaccatcacctggggcacacacgatctaccaactagccccgaagccgaccacatcacacccgtcagcaggggaggactcaacaccctcgacaacgggcaaatcatctgcagaacatgcaacagaagcaaaggcaatcgcagcgaaccaaacatcaagttccaacaacaaaccacaaaaacattgattccatggtgaaaaacctgccaacccccaccggggacaccccctgcacacccgtgcaagacc

SEQ ID NO: 48 - DNA, 29492 bp, Unknown
  source: /note="Description of Unknown: Bacteriophage of P. acnes"
cctcccttttgtggattagtctatttgtcgactttttgcgttggtggtgagtgtggtgcagcctgagcttccggagagtcgcgattggtgtgaggagacgcgtcgttggtggcgtgtgtggggtgaggatagccgtgcccagtttgtgtctgacgaggagtggctgtttcttcttgatgcggctgtgattcatgatgtggtgtggagtgagggccgggcggatttggtggcttcgcttcgtgctcatgtgaaggcgtttatggccatgttggatcggtattcggttgatgtggcgtctggtggccgtggtgggggttctgcggtggcgatgattgaccggtataggaagcgcaagggggcctgattaggtgtctggtgttgttgggtctcaggttcctcgtcatcgtgtggctgcggcgtattcggtgtctgctggcggggatgcgggtgagcttggtagggcttatgggttgacgcctgatccgtggcagcagcaggtgttggatgattggcttgctgtgggtggtaatggcaggcttgcttcgggtgtgtgtggggtgtttgtgcctcgccagaatggcaagaatgctattttggagattgtggagttgtttaaggcgactattcagggtcgccgtattttgcatacggctcacgagttgaagtcggctcgtaaggcgtttatgaggttgaggtcgttttttgagaatgagcggcagtttcctgacttgtatcgtatggtgaagtcgattcgtgcgacgaatggccaggaggctattgtgttgcatcatccggattgtgccacgtttgagcgtaagtgtggttgtccgggttggggttcggttgagtttgtggcccgttctcgkggttcggctcgcgggtttacggttgatgatttggtgtgtgatgaggctcaggagttgtcggatgagcagttggaggctttgcttcctacggtgagcgcggctccttcgggtgatcctcagcagatttttttgggtacgccgcctgggccgttggctgacgggtctgtggtgttgcgtttgcgtgggcaggctttgtcgggtggtaagaggtttgcgtggacggagttttcgattcctgacgagtctgatccggatgatgtgtcgcggcagtggcggaagttggctggtgatactaatccggcgttgggtcgtcgtctgaattttgggactgtgtcggatgagcatgagtcgatgtctgctgccgggtttgctcgggagcggcttggctggtgggatcgtggacagtctgctacgtctgtgataccggccgataagtgggttcagtcggctgtgggtgaggcggctctggttggcgggaaggtttttggtgtctcgttttctcgctcgggggatcgtgtcgcgctagctggtgctggcaagactgatgctggggttcatgttgaggttattgatggcctgtctggcacgattgttgatggtgtgggccagctggctgactggttggcgttgcgttggggtgacactgaaaagatcatggttgccgggtctggtgcggtgttgttgcagaaggcgttgacggatcgtggtgttccgggtcgtggcgtgattgtggctgatactggggtgtatgtggaggcgtgtcaggcgttcctggagggtgtaaggtctggtgtggtttctcaccctagggctgattcgaggcgtgacatgttggatattgctgtgaggtcggctgtgcagaagaagaagggttctgcgtggggttggggttcctcgtttaaggatggttctgaggttcctttggaggctgtgtctttggcttatcttggtgcgaagatggcgaaggctaggcggcgtgaacggtctggtaggaagcgggtgtctgtggtatgaactcggatgagttggctctgattgagggcatgtttgatcgtatccaaaggttgtcttcgtggcattgccgtattgagggctactatgagggctctaatcgggtgcgtgatttgggggtggctattcctcccgagttgcagcgtgtgcagacggtggtgtcgtggcctggtattgctgtggatgctttggaggagcgtctggattggcttggctggactaatggtgacggctacggcctggatggtgtgtatgctgcgaatcggcttgctacgacttcgtgtgatgtgcatttggatgcgctgatttttgggttgtcgtttgtggctatcattcctggcggtgatggcactgtttctgttcgtccgcagtcaccaaagaattgtacgggcaagttttctgccgatgggtctcgtttggatgctggccttgtggtgcagcagacgtgtgatcctgaggttgttgaggctgagttgttgcttcctgatgtgattgttcaggttgagcggcggggctcgcgtgagtgggtcgagatgggccgtatcgtgaatgtgcttggtgcggttcctttggtgcctattgtgaatcgtcgccgtacgtctaggattgatggccgttcggagattacgaggtctattagggcttacactgatgaggctgtgcgcacactgttggggcagtctgtgaatcgtgatttttatgcgtatcctcagcgttgggtgactggcgtgagtgcggatgagttttcgcagcctggctgggtcctgtcgatggcttctgtgtgggctgtggataaggatgatgacggtgataccccgaatgtggggtcgtttcctgtcaattcgcctacaccgtattcggatcagatgcggctgttggcgcagttgactgcgggtgaggcggctgttccggaacgctatttcgggtttatcacgtctaacccacctagcggggaggctttggctgccgaggaatctcggcttgtgaagcgtgctgagcggcgtcaaacgtcgtttggtcagggctggctgtcggttggttttttggctgccaaggcgttggattctcgtgttgatgaggccgcgttttttggtgatgttggtttgcgttggcgtgatgcttcgacgcctacccgggcggctacagctgatgctgtgacgaagcttgttggtgccggtattttgcctgctgattctcgtacggtgttggagatgttggggcttgatgatgtgcaggttgaggctgtgatgcgtcatcgtgctgagtcgtctgacccgttggcggcactggctggggctatatcgcgtcaaactaacgaggtatgataggcgatggcttcgggggttgaggcgaggcttgctgcgactgagtatcagcgtgaggcggtcaggtttgctgggaagtatgcgggctattattctgagcttggtcgtttgtggcgtgccggcaggatgagtgacacgcagtatgtgcgtttgtgtgtggagttggagcgtgccggccatgatggttcggcgtcgttggctgccaggtttgtgtcggattttcggaagcttaacggtgtggatcctggtttgatcgtgtatgacgagtttgatgctgccgccgcgttggctaggtcgttttcgactatgaagattcttgagagtgacccggatagggcgaatgacacgattgatgcgatggcggcgggttttaatcgggctgtgatgaatgctggccgtgacacggttgagtggtctgcgggtgcgcagggtaggtcgtggcgcagggtgactgatggtgatccgtgcgcgttttgtgccatgttggctacgaggtcggattatacgacgagggagcgggcgcttactactggtcatactcggcgtcataagcgtgccggtaggcgtccgtttggttcgaagtatcatgatcattgtggttgtacggtggttgaggttgttggcccttgggaaccgaatagggctgatgccgagtatcagaggacgtatgagaaggctcgtgagtgggttgatgatcatgggttgcagcagtcgcctggcaatattttgaaggctatgcgtactgttggcgacatgagatgatggtttccggttgtgtgccgccggttattggtgcacagggttgtctcccgcacgggggtcaacaatgttgtgttgttttccgcaaggagtgtagggttaggctatggccgatcagagtgttgaggaacagaatgttgacaatgatgttgtggagtctggaaaggataacggcattgttgatacggtaaaagacgatggcgggcaggaggtagccgacaatcagttgaagaatgaaggcggtgataagccgtctgggactgattggaaggcggaggctcgcaaatgggagtctcgtgctaaaagtaattttgctgagctagagaagcttcgctccacgggtgataattcagagtctactattgatggtcttcgtcgtaaaaacgaggaacttgagagtaggctgaacgagcttgttttggagggtgtgaagcgtgaggtggccaccgagcatggcctctcggctgatgctgtagctttcttgtctggtggtgatcgtgagtcgcttgccgagtctgctaaagctcttaaggggctgattgaccatagtggtagtggtggcgctggtgtgcgccgtcttgcggggagtgcccccgtgactgatgagaagcatcgcgagggtgtcgctttcgtggatgctttagtaaacaattctaggagatgatttatcatggctgacgattttctttctgcagggaagcttgagcttcctggttctatgattggtgcggtgcgtgaccgtgctatcgattctggtgtgcttgctaagctgtcgccggagcagccgacgattttcgggcctgttaagggtgccgtgtttagcggtgttcctcgcgctaagattgttggcgagggcgaggttaagccttccgcatcggtggatgtttcggcgtttactgcccagccgatcaaggttgtgactcagcagcgtgtctcggacgaatttatgtgggctgacgccgattaccgtctgggtgtgcttcaggatctgatttcgcctgctctgggtgcctcgattggtcgcgccgtggatctgattgctttccatggtatcgatcctgctacaggtaagcctgctgcggctgtcaaggtgtcgcttgataatacgtcgaagacggttgatgcaaccgatagtgctacggctgatcttatcaaggcggttgggctgattgctggggccggtttgcaggttcctaacggtgttgctttggatccggcgttctcgtttgctctgtctactgaggtgtatccgaaggggtctcctcttgccggtcagccgatgtatcctgcagctggtttcgcggggcttgataattggcgtgggctgaatgttggtgcttcttcgactgtttcgggtgccccggagatgtcgcctgcttctggtgttaaggctattgttggtgatttctctcgtgttcattggggtttccagcgtaacttcccgatcgagctgatcgagtatggtgacccggatcagactggtcgcgatttgaagggccataatgaggttatggttcgtgccgaggctgtgctgtatgttgcgattgagtcgcttgattcgtttgctgttgtgaaggagaaggctgccccgaagcctaatccgccggccggtaactgatttattgtagcggtgatatgtatatgtgcagggggtggtgttgatgggtatcattttgaagcctgaggatattgagcctttcgccgatattcctagagataagcttgaggcgatgattgccgatgtggaggctgtagctgtcagtgtcgccccctgtatcgctaaaccggatttcaaatataaggatgccgctaaggctattctgcgcagggccctgttgcgctggaatgataccggggtttcgggtcaggtgcagtatgagtcggcgggcccgtttgctcagacgacacggtcgaatactcccacgaatttgttgtggccttctgagattgctgcgttgaagaagttgtgcgacgagagtggtggcgctggtaaagcgttcacgatcacacccacgatccgtggtggatatgctcattctgaggtgtgttccacggtgtggggtgagggttgctcgtgcgggtcgaatattaacggctacgctggccctttgtgggagatatgatatgaccagttttccttacggtgaaacggttgtgatgcttcaaccgactgttcgtgtcgatgatttgggcgacaaggtggaggattggggtcatcctgtcgagactgtgtaccataatgtggccatctatgcttccgtttcgcaggaggatgaggctgcggggcgtgactcggattatgagcattggtcgatgctttttaagcagcctgttgtgggtgccggttatcgttgccggtggcgtattcggggtgttgtgtgggaggctgacgggtctcctatcgtgtggcatcacccgatgtccggttgggatgctggtatgcaggttaatgtgaagcgtaagaagggctgatgggttgtggctcaggatgtgaatgtgaagctgaacttgccgggtattcgtgaggtgttgaagtcttctggggtgcagtcgatgttggctgagcgtggcgagagggtgaggcgtgcggcctcggcgaatgtgggcggtaatgcttttgatagggcccaataccgtaatggtttgtcgtcggaggtgcaggttcaccgtgttgaggctgtggcgaggattggcaccacctataagggtggtaaaaggattgaggcgaagcatggcacgttggcccggtcgattggggctgcgtcgtgatcgtttatggtgatccgcgtgtgtgggctaaacgtgtgctcaaggatgatggctggctgtccgatataccttgtactgggacggtgcctgaggatttcagcggtgacttgatttggttggcgttggatggtggtccgcagttgcatgttcgtgagcgtgtttttttgcgggtgaatgtgttttctgatatgccggatcgtgctatgtcgctagctaggcgtgttgaggctgtgctggttgatggggttgacggtgatcctgtagtgtactgtaaacggtctactggccctgatttgctggttgatggtgcacgttttgatgtgtattcgctttttgagctgatatgcaggcctgtcgaatccgagtaaacgttttgttttgatattgttgtttgtttttgtttgatattatttttgggggttgtgatggctgctacacgtaaagcgtctaatgttcgctctgctgttaccggtgacgtctatattggtgccgctcatgctggtgacactattgatggtgttgggaagattcctgacggtcttatcgctttagggtatctgtcggatgacgggtttaagattaagcctgagcgtaaaacggatgatttgaaggcttggcagaatgcggatgttgttcgcactgtggctacagagtcgtctatcgagatttcttttcagctgattgagtctaagaaggaggttattgaactgttttggcagtcgaaggttactgccggagccgattcgggttcgttcgatatttctcctggtgccaccacgggtgttcatgccctgttgatggatattgttgatggggatcaggttattcgctactatttccctgaggctgagcttgttgatcgtgacgagatcaagggcaagaatggcgaggtgtacgggtatggtgtgacgttgaaggcttaccctgctcagattaataagaagggtgatgcggtgtctggtcgggggtggatgacggctttaaaagctgatactcctccgactcctcctccggccccggttcctccgaagcctcagccggatccgaatcctccgtccgataactgatacacgattttaggggattgttgatagatgagtgacactggttacacgttgaagattggtgaccgtagctgggtgttggctgatgctgaggagacggcgcaggctgttcctgcccgcgttttccgtcgtgccgccaggattgcgcagtctggggagtctgcggatttcgcccaggttgaggtgatgttttctatgttggaggctgccgccccagctgacgcggtggaggccctggaggggcttcctatggttcgtgtggcggaggttttccgtgagtggatggaatacaagcctgacggtaagggtgcctcgctgggggaatagtttggctccacggcctgattgatgattatcgtggggccatcgaatacgatttccgcaccaagtttggtgtttctgtttatagtgttggtggccctgtgatgtgttggggtgaggctgtccggctggctggcgtgttgtgtaccgatacgtctagccagttggcggcccacctgaatggttggcagcgcccgtttgagtggtgtgagtgggctgtgttggacatgttggatcattacaggtctgctaatagtgaggggcagccggagcctgtggcgaggcctacggatgagcgtagggcccggtttacgtctgggcaggtggacgatattttggcgcgtgttcgtgccggtggcggggtgtctcgcgagattaatattatggggtgaatagtgtatgtctggtgagattgcttccgcatatgtgtcgttgtatacgaagatgcctggtttgaagtcggatgttggtaaacagttgtcgggtgttatgcctgctgagggtcagcgttcgggtagcttgtttgctggcgggatgaagttggcgcttggtggtgcggcgatgatgggtgccatcaatgttgctaagaagggtctcaagtctatctatgatgtgactattggtggcggtattgctcgcgctatggctattgatgaggctcaggctaaactgactggtttgggtcatacgtcgtctgatacgtcttcgattatgaattcggctattgaggctgtgactggtacgtcgtatgcgttgggggatgcggcttctactgcggcggcgttgtctgcttctggtgtgaagtctggcgggcagatgacggatgtgttgaagactgtcgccgatgtgtcttatatttcgggtaagtcgtttcaggatacgggcgctatttttacgtcgattatggcgcgcggtaagttgcagggcgatgacatgttgcagcttactatggcgggtgttcctgtgctgtctctgttggctaggcagactggtaaaacgtctgctgaggtgtcgcagatggtgtcgaaggggcagattgattttaacacgtttgcggctgcgatgaagcttggcatgggtggtgctgcgcaggcgtctggtaagacgtttgagggcgctatgaagaatgttaagagcgccctgggttatttgggtgctacggctatggccccgtttttgaacggcctgcggcagatttttgttgcgttgaatccggttattaagtctatcacggagtctgtgaagcctttgtttgcgtcggtggatcaggggattcagcggatgatgccgtctattttggcgtggattaaccgtatgccggctatgatcactcgaatgaatgcacagatgcgcgccaaggcggagcagttgaagggcatttttgcgaggctgcatttgcctgttcctaaggtgaatttgggtgccatgtttgctggcggcaccgcagtgttcggtattgttgctgcgggtgttgggaagcttgttgcggggtttgccccgttggctgtgtcgttgaagaatctgttgccgtcgtttggtgctttgaggggtgccgctggcgggcttggcggcgtgtttcgcgccctgggtggccctgtcggtattgtgatcggcttgtttgctgccatgtttgctacgaacgcccagttccgtgccgctgtgatgcagcttgtgggggttgttggccgggctttggggcagattatggtcgccttgcagccactgttcggtattgttgctggcgtggttgccaggttggcgccagtgttcggccagattatcggtatggttgctggtttggctgcccggctggtgcctgttattggtatgcttattgcccggctggttcctgttatcacccagattattggtatggtaacccaggttgctgccatgttgttgcctatgctgatgccggttattcaggctgttgttgctgtgatacggcaggttattggtgtcattatgcagttgatacctgttttgatgccggttgtgcagcagattttgggtgctgtcatgtctgttttgccgccgattgttggtttgatacggtcgctgataccggtgatcatgtcgattatgcgtgtggtggtgcaggttgttggtgccgtgctacaggtggtggcccgtattattccggttgttatgccgatttatgtttcggtgattggattcattgccaagatttatgctgcggttatcgtttttgaggctaaggttattggcgctattcttcgtactattacgtggattgtgaatcattcagtgtctggcgtgaggtctatgggcacggccatccagaatggctggaatcatatcaaatcgtttacgtcggcgtttattaacggtttcaagtcgatcatttctgccggtgttgccgcggttgtggggttttttacgcggcttggtttgtcggttgcctcccatgtgaggtctggttttaactcggcccgtggtgcggtttcttctgcgatgaatgctattcggagtgttgtgtcttcggtggcgtctgctgttggcgggtttttcagttcgatggcgtctcgtgttcggaatggtgctgtgcgcgggtttaatggtgcccggagtgcggcatcttctgctatgcatgctatggggtccgctgtgtctagtggtgtgcatggtgtgctgggttttttccggaatttgcctggcaatattcggcgtgcgcttggtaatatggggtctttgttggtgtctgctggccgtgatgtggtgtctggtttgggtaatggtatccggaatgctatgagtggcctgttggatacggtgcgtaatatgggttctcaggttgctaatgcggcgaagtcggtgttgggtattcattctccgtctcgggtgtttcgcgaccaggttggccgtcaggttgttgccggtttggctgagggtattactggtaatgcgggtttggcgttggatgcgatgtcgggtgttgcttcgcagcttccggatgctgtggatgcccggtttggtgtgcggtcgtctgtgggctcgtttaccccgtacgaccggtatcggcgtgcgagtgagaagagtgttgtggtgaatgttaacggacccacgtatggtgatcctaacgagtttgcgaagcggattgagcggcagcagcgtgacgctttgaacgcgttggcttacgtgtgattgggggtgttgtgcatgtttattcctgacccgtctgatcgtgccggtttgactgtggattggactatgtttccgttggttggtaatgctccggagcgtgtgcttcatttgacggattatacggggtcgtctcctgtcatgttgttgaatgattcgttgcgcggcctgggtgttcccgagattgagcatttttctcaaacacatgttggggtgcacggctcggagtggcgcgggtttaatgtgaagcctcgcgaggtgacattaccggtgttggtgtcgggtgttgacccggatccggatggcgggtttcgtgacggttttttgaaggcgtatgacgagttgtggtctgcttttcctcctggcgaggagggggagttgtctgtgaagactcctgccggcattgagcgtgtgttgaagtgccggtttgattcggctgatgacacgtttacggtggatccggtgaacaggggttatgcgcgttatctgttgcatttgacggcttatgacccgttttggtatggggatgagcagaagtttcgtttcagtaacgcgaagttgcaggattggttgggtggcggccctgtcggcaagaagggtacagcgtttcctgtggtgttgacgcctggtgttggttcgggttgggataacctgtctaataagggtgatgtgcctgcgtggcctgtgattcgtgtcgagggccctttggattcgtggtctgtgcagattgatggtttgcgtgtgtcatcagactatcctgtcgaggagtatgattggatcactattgacacggatcctcgcaaacagtctgcattgttgaacgggtttgaggatgtgatggatcgcctgtctgagtgggagtttgcgcctattcctccggggggttctcggagtgtgaatattgagatggttggtttgggtgccattgttgtgtcggtgcagtacaggtttttgaaggcttggtgaatggttgatggctggtcttgttccgcatgtaacattgtttacgcctgattatcgccgtgtggcgcctatcaatttttttgagtcgttgaaactgtcgttgaagtggaatggtttgtccactttggagttggtggtgtctggggatcattccaggcttgacgggttgacgaggccgggtgcacggctggttgttgattatggtggtggccagattttttctgggcctgtgcgtaaggttcatggtgtgggtccgtggcgttcttcgcgggtgactatcacgtgtgaggatgatattcgtctgttgtggcgtatgttgatgtggcctgtgaattatcgtcctggtttggttggtatggagtggcgtgccgacagggattatgcccactattcgggtgcggctgagtcggtggctaagcaggtgttgggggataatgcttggcgttttccgcctggtttgtttatgaacgatgatgagagtcgtggccgctatattaaggattttcaggcccggtttcacgtgtttgccgataagttgttgccggtgctgtcgtgggctcggatgactgtcacggtgaaccagtttgagaatgtgaagtttgatcagcggggtttggtgtttgattgtgtgcctgctgtgacacggaagcatgtgttgactgccgagtcgggttcgattgtgtcgtgggagtatgtgcgtgacgcccctaaggctacttcggtggttgttggtggccgcggcgagggtagggatcggctgttttgtgaggatgttgattcgatggccgaggatgagtggtttgatcgtgtcgaggtgtttaaggatgcccgtaacactgattccgagaaggtgtctctctttgatgaggccgagcaagtgttgtccgagtcgggggcctcgtctgggtttaagatcgagttggctgagtcggatgtgttgcggtttgggcccggcaatctgatgccgggggatttgatctatgttgatgtgggttctggccctattgcggagattgttcggcagattgatgtggagtgtgattcgcctggtgatggttggacgaaggtgacaccggttgcgggggattatgaggataatccgtcggcgttgttggcgcggcgtgtggctggtttggctgcgggtgtgcgggatttgcaaaaattctaaaaagattaggggtttgttgtgggtattgtgtgtaaaggttttgatggtgtgttgaccgagtatgattgggctcaaatgtctggtctgatgggtaatatgccgtctgtgaaagggccggacgattttcgtgtcggcacgacgattcagggtgccacggtgttgtgtgaggttatgccggggcaggcttgggctcacggggtgatgtgcacgtcgaatgatattgagacggtgacggggcagcttccgggcccgggtgagacccgctacgactatgttgtcctgtcgcgggattgggaggcgaatacggccaggttggagattgttcccggtggccgtgcggagcgtgcccgtgacgtgttgagggctgagcctggcgtgttccatcagcaactgttggcgactttggtgttgtcgtctaacgggttgcagcagcagcttgacaggcgtgccgtggcggctagggttgcgtttggggagtctgcygcgtgtgatcctacccctgtggagggtgaccgggtgatggttccttcgggggctgtgtgggctaaccatgctaacgagtggatgctcctgtctcccaggattgagacgggttctaagcagatccagtttggcgggtctgctgtgtatgcttacacgatcccgtttgatcgcccgttcactagtccgcctgttgtggtggcgtctatggctacggcggctgggggcacgacccagattgatgtgaaagcctacaatattactgccaaggattttagtttggcgtttattacgaatgacgggtctaagccgaatggtgtgcccgcaatagctaactggattgctgtcggcgtgtgactgtacaggtgttgtggcggatgttgtaatgttggggggctgtggtgtcgtggtttactcctgcactggtggcctctatctgtaccgcgttggccacgattttgggttcagttcaggcggtcacatctaaatcgaggaagcgtttacgcaggctatctgcgcaggttgatgcgatggaagagtatatgtggggtgtgcggcgtgaggtgcgccggtttaacgcgaggcttcctgatggggtggagcctatgcatcttcctgatttgcctgagtttttgaaagatactgttgatggtggaggtgagtagggttgagggagttggaggaggagaagcggcagcgccgcaattttgagaaggcttcactggtgttgttgtttttgtcgcttgtgctgttgatggtggttgctgggggtgctttgcgtttcggatcgctgtcttctgagcgggattctgagcaggcgagggcccagtcgaatggtacagccgctaaaggtttagctgcccgtgtgaagcaggtgtgtgcctctggtgggcaggagtctgtgcggcttcaccagtctggcttgtgtgtggatgctcagcgtgttgaackgmgtgtgcagggtgtgccgggtcctgccggtgtgcgcggcccgcaagggcccgccggtgtgaacggccgggatggtgttaatggttcggccgggctggttggccctgttggtccgcagggttctccgggtttgaatggtgtgaagggtcctgacgggctgcccggcagtgacggccgggatggtgtcgatggtgtttcgggccgtgcaggcgtggacggtgtgaacggcgctgatggcaaggatggtcgtgatggttctgctggtgagcgtggcgatgtggggccttcgggtcctgccggcccccctggcgcgcagggtgagcgtggccctgctggtgtgaacggatccgatggtaaagatggtaaggatggcgctgatgggcgttcggtgatatcggtgtactgttccgggggccgcctggttgtgaaatatagtgacggtacggcctctaccgtgtcgggttctgcagcctgtgagagtgtgaaaccgtcacctgtggttaccgtatcatcccataggtgaacaagaagagggaagggtgttactagtgttggtcgtgtttgggggtggtgtgtggtgagatacattccagcggcgcatcactcggccggttcgaatagtccggtgaatagggttgtgattcatgcgacatgcccggatgtggggtttccgtccgcttcgcgtaagggtcgggcggtgtctacggcgaactatttcgcgtccccatcggcgggcggttcggcgcattatgtgtgtgatattggggagacggtgcagtgcctgtcagaggggactattgggtggcatgccccgccgaatccgcatagtttgggtatagagatttgcgctgatggtggttcgcacgcctcgttccgggtgccagggcatgcttacactcgtgagcagtggcttgatccgagggtgtggcctgccgtggagaaggccgccatcctgtgtagacatttgtgtgacaaatataacgttccgaaaaggaagcttagtgcagccgatttgaaggccggtaaacgtggtgtttgcggccacgtggatgtgacggatgcgtggcatcaatcggatcatgacgatccggggccgtggtttccgtgggacaggtttatggccgtcgtctgcggcggcagtggagatagtggggagttaactgtggctgatgtgaaagccttgcatgatcagattaaacaattgtctgctcagcttactggttcggtgaataagctgcaccatgatgttggtgtggtacaggtacagaatggtgatttgggtaaacgtgttgatgccctgtcgtgggtgaagaatccggtgaccggaaaactgtggcgcacaaaagacgccctgtggagtatctggtattacgtgctggagtgtcgcagccgcatcagtaggctggagtctgctgttaacggtttgaaaaagtgatggtggtttgttgtgggtaaacagttttggttaggtttactggagcgggcggctaagacttttgttcaaacgtttgttgcggtgttgggggtgacggcgggtgtcacgtatactgcggagtcgtttcgcggtttgccgtgggagtctgccctgataacagcaacggtggctgcggtgttgtcggttgctacatcgtttggtagtccgtcgtttgtggccggcaaacctaaaaccacggttgtggatgctgggcttgttccacccgacgatgggggtttggttgagcctcactcggttgatgtgtcggatcctggcatgattgagcctgtagatgatgcggatcttggtgtgggctatgtgccgaaacacgctgccgagtcggaggttggcacggtagagtctactgttgcataagtgaatatagatgtgtgccccagcggtgctgccacggttgtgtggtggttgccgctggggcactatttctgttttatgcggtgtggctatgattcgttgctgtcgatggtgtcttcgagcatctggtacaggtggaggcaggtgcagatcgtttcgctggcctggtctagaacgttccggccgataacgtttttgtggttgtcgcggtggcggatgatagcccacatgatctcgtcggctgccgcctgtaatagtttggcctggtatgcgattccggcgagccagtctagtgcttccgggcttgcctgtgtgtcgtctggaatgccgcgggtgttactgttgcttgtggggtgtcctgcactgtcgcatagccataggatttcgctgcactcgtctagcgtgtcttggtcgatagcgagatcgtcgaggctgacattgttgacggtaaggttcacgttgtcgagggagatgggtacaccgtactggttttcgacactgtcaacaatgttttgtagttgttgcatgttggtgggctgttgttggacgatacggtgtatcgctgtgttgagggtggtgtaggtgatgttgtgtgtgttgttcatggttttatcccatccctgtgctgtcgtcgttttcgtctggcatgtagtatgtgctgtttgcgtactcggttaacgtcatcagtgtttggtctgcccactgtttcacggtttgccgggtgacacccaatcgttgggcggctgtggcgtaggtttggtcgtatccgtagacttcccggaatgctgccaacctagctaaatgttttcgctgtttggatggttcacaggatagtgtgtagtcgtcgatggctagctgtagatcgatcatggtggcaatgttgttgccgtgatgctggggggcggttggtgggggtggcattcctggctccacggagggtttccatgggccgccgttccagatccattgcgcggcttgaatgatgtcggcggtggtgtaggttcggttcactggtcatcccctgaacaggtcgttggtgttggtggtgtcgaatcgtccgacgcagtggcagtagtcgtacatgagtttgataatgtgttggtggtctcccaaataggtgtttccgctgatgctgtaggtggctgtgccgtctttactaatggtgtatttggcggtgatggtttcggggttttcggtgtcggtgatgattgctgtggtggtggcgcctactgtttgtagcacggtggtttgagttccgtcgtcgatggtggttttaaccatggtgtgtgttctcccctttcagttgctggtttggttgtcggctagatgaatgatatcgggtaagggtttcggctggtcgaggtgttgtatggttttgttggctaaacgtttggctaccctgtaacacattttggtgtagtgtttgttgtctaggttgtggtattgttcccgcaccgcaatatatagtagagagtcttggtacaggtcgtctgcactgattgcggggtagtgtgcggctgttttggtgcatgcccggttgagtgtgcgtagatgatggtctgtggcccaaacccacgatgcggtggtggcgaggtctgctttggttggtcgtcggctcatggcatctctttcatcgggctatctggtagttgtttggtgttttgttgttgatagtgtagcacacgagtccggggtttccggtggtgcccgtcttgtgccggtaccatgtggattcgccttccatggaggggcattggatgaaggtgcgttgtccttgctcggagatttctaggtgatgccgatgcccggccatgagaatattagatgtggtgccgttgtggaattcttggccgcgccaccaatcatagtgtttgccggtgcgccattggtggccgtgggcgtgcaggatggtagccccggctacgtctacggtggtggtcatttcgtctcggctggggaaataaaagtgtaggttgggatactggttgttgagctggtaggcttctgcgatggcgcggcagcagtccacatcgaaggagtcgtcgtaggtggtgacgcctttgccgaatcgtacggcttcgccgtggttgccggggatggatgtgatggtcacgtttttgcagtggtcgaacatgtggacgagttgcatcatggccatgcgggtgagcctgatttgttccgtcaagggggtttgtgtgcgccaggcgttgttgccgccttgtgacacgtatccttcgatcatgtcgccgaggaatgcgatgtggactcgctcgggtttgcctgcttgttgccagtagtgttttgcgacgatgagggagtgtaggtagtcgtcggcgaagtgtgatgtttctccgcctgggatgcctttgccgatttggaagtctcctgccccgatgacgaaggctgcggtgctgtagtcggtgcgggtgtccggttcgggttttgggggtgcccattcggctagcttgtcgacgagttcgtctacagggtaggggttggttgcgggttggtggtcgatgattttttgtatggatcggccggtttctccgttcggtaaggtccattcagagatgcgtgtgcggcgcacggtaccgttggctagattgtcgtcgatggtgtcgatggcgttgtcgtggttggctagttgtgtgaggagccggtctatgttgtctatcactgggtatcctcctcgtgtggggtggtgttggcttgtttgcggcggtagtctttgatgacggtggcggagatggggtatccggcttgggtgagttgttgtgctagccaggaggcgggtatggacctgtctgcgagcacgtctgcagccttatcgccgtagcgttggatgagggtttcagttttggttgccatggtgtcctatcggttgtgtggtgggctgccatcctgtgcggcagtcgccgtcgtgtcctggtttgcgtgtgcaccacgatgttgttccgtctgtgtggttgagtgttttaccgcacatgacgttttgtagatgctctggcagctggtcatcctggttgctggtttgtgtgtcgaagagtgttttttggttggtgaaatgctcggacacggtgccgttrtgcacgggtagtatccatgttttccattgttgttgtagccgggtgttccagtggaattgtttggccgcgttttcggcctgttttaaggttttgtagtagccgactagtatgcgctggtgttcactgtcgggtgggttttggcctcgccagtattgtgccgctacggcgtaccggttgctggctgtgaagatttgccagcagtattcgataatgtgttgcaatactgtgtctggcaggctgtcggggttgatggtgatgttttgggtgatgatgccacggatggcttgccggtttttggtggtgggtttgaacgagatgctcacgatagtaccggctgctggtcttgcatgaactggttgaaggtgttgttcccggcatgttgggcttgtgtgatttgttggtcagaccagtcggggtgttgctgtttgaggtagtgccagtggcacgcattgtaggtttcgttttgtagccgtgtgagatggttttcggtgatgatttgtttccacattgtccatgatacgtctagccggtcgaggatttcaagggctgggatgttgaattggtcgaggaagaggatttcgtgggtgtagtagtttttctcgtattggtcccatccgcttcggtgcctgttggactggtttttggggtaggcttcccggcatactttgtgtaaacgtttggtcatgtcgtcgggtaggttaatgtcggggttggcgcggatcatggatcgcatcccatcataggtggtgccccaggtgtgcatgatgtaggtggggtcttctccgtcagcccatttttctgcacagatggcgaggcggatacgcctcctggctgcttggctaatgttgcgccggttggggatggggcacgtgtcgaggggatccatgatgttttagtgtacctttctagtttcgtgttgttgacgtgttttactgtagcacagtgtctagtgcttgtgtcaaccctgtttttccggcctgcaggtaggtgtctgtgacatcccccagggtgaggggcacatgggtggcttggggtagtgctgcctggagggtttgggccatctggtctcccgctttgtctgggtcggaccagatgtagatgtggtcgtagccttcgaagaatttggtccaaaagttttgccacgaggttgcgccgggtagggcgacggccgaccatccgcattgttcgaggatcatggagtcgaattcgccttcgcaaatgtgcatttcggctgccgggttggccatggcggccatgttgtatatggagcccgtgtctcctgccggggttaaatatttggggtggttgtgggttttgcagtcgtgctggagtgagcagcggaaacgcatttttcttatttcggctgggccgccccaaacggggtacatgtatgggatggtgatgcactggttgtagtcttcgtggcctgggatggggtcattgttgatgtatccaaggtggtggtagcgggctgtttcttcgctgatgcctcttgccgagagcaggtcgagtatgttttcgaggtgggtttcgtagagggccgaggctttctggattcggcggcgttccgcaatgttgtatgggcgtatgctgtcgtacattcgggttttcttcttctaatcgttgttgtagtttggcgagtccgcctccgacaccgcatgtgtggcagtaccagacgcccttgtcgaggttgatgctcatggagggctggtggtcgtcgtggaacgggcagaggatgtgttgctcgtttttggacggattgtagcgtatctggtaggtgtcgaggaggcggcaggtgtcagaggtgtgggaggagctcgttgagggttgataccacatatgcttcgctccatggcttgttgcgctgtttcatcactacgagtccgatggtggactggctttctcggtttcggtgggtttcgtagttgcgtgcctcccggctggcttgtttcacgaattcggctaggtgtggctggccggctttggcttctatcacataggttttgtggctggttgtgaggatgaggtcgccttcatcctctttaccgttgaggtggaggcgttcgatattgtggccggtgtcgcgtagctggtggaggagtcgtgtttcccactcggccccagctcgcctattcctggattgctgtgtagccatcatagtcctttgtgtgttgtggtcatgttccagggctgtttttcggcgagtggcccgaagaatgtgtattcggggtaggctcgtagccgctcgtatcgggttccgtcggggctggatttgcctgtgcgctgttttagcactgcgatgcgtgcctctgccggtatcgtgagcccgttgccgttatcctcgccaccatacagtgagactccgaggatgagttgtggtttttcggagaggccgtttttgatttctcgccgggcgggcgggtgttcgatgtcggagccggttttgtcggttgcgtggtgggtgacgatgatggtggagccagtatctctacctaatgctgtgatccattgcatggcttcttgctgggcctggtagtcggattcgcagtcttgaatgtccatcaggttgtcgataacgatgatgggtgggaaggtgttccacatttccatgtaggcttgcagttccatggtgatgtcggtccaggtgatgggtgactggaatgagaatgtgatgtgttggccgtggtggatgctgtctcgatagtattctggcccgtagtcgtcgatgttttgttgtatctgtgtggtggtgtgttgggtgttgagtgagatgattcgtgtggaggcctcccagggtgtcatgtcccctgatatgtagagggctggctggttgagcatggcggtgatgaacatggctagccctgatttttggctgccggagcgccccgcgatcatgactaggtcccctttgtggatgtgcatgtcctggttgcggtagaggggttctagctggggtatgcggggcagctcggctgcggtttgggaggccctctcgaaggatctttgtagagagagcatcggagccttaatctatctatcggttggatgttgttttggtggtcagatggagtcgatatcgatgtcagcctcagttgaggctgtggtgtcgtctagctgaccgttatcgcgcttgtctacgtattcggcaaccttatcgtagatggcgtcgtctaatggtttgagtacgaccgcgttgaacccgtttttggtgcgtacggtggcgagtttgaaggcctgctcttcgccaaggtatgcttcgagttcgcggatcatggagtgtgkgcggtcgttgttgcctcgcgctttctcaataatagcgttggggatggtttctggggtgccgttgttgagatcgtctagggtgtggaagatggtgacatcagcatagatgcgatcagcggtctgtccgccgtagccttcagtgttgtgttccacgtcgtgcactttgaaggcgatggcggtggcgtcctggtttttggacgggttgaagaaggtgctgttattgctgttgcggtagttggcaagtcccataatggtgttatcctttactgttgtgtctgttattgttggcttatattggtttatcgggtgaggctgtttcgtttagtgcggaaagcctcggacacgtcactgttactggtgatgatctttttgtactgttttagaaggtctgctagctgtgctttgctggtggctttgttgatccggtcaatgatgatgtcgttttcctgattggcgattttgtttacgtagtctttggcggcctgattgtatcggtcttggaggatgatggatgcgctagctatgagggttgcgaggtcccagtctttcgatacggtttcgtctttcaatcctcccagcaggtcgatgatggcctgttttgtctgctctgctgtgtctcccctaatgacggtccatggtgcagcatagtctccaccatatttgagtgtgatagtgagtcgatcattgtctgtggtgtgctcgtcggtcatgtgttttccttttctttgttttcggcttctggaggctgtacggtggtttctaccgggtatctgtacgagttttttccgttgacggcccagcaggcgtctcgtacggggcatcctttacagagtgctgtgacgtggggtacgaagatgccttggctgattcctttcattgcttgactgtacatggatgatacatgccggtaggtgttgttgtcaagatcgtacagttcggtggatgttccctgcttggcggactgtttgtctgttttggttgatgcgggtgtccaaaacatgccttttgtcacatcgttgccgtgttgggcgagcatgtaccggtaggtgtgcagctgcatactatcagccggtaggcgcccggttttgaggtcgaggatgaatgtttcgccggtgtcggtgtcggtgaaaacgcggtcaatatatccgactatttttgtgtcatcgtcgaggatggtttctaccgggtattcgatgcccggctcgccgtcaataacagcgatagcatattctggatggttgcgcctccatgttttccagcggttcacaaaggtttgtccgtagagtatccaccagtcgtagtctttcttgtgtggcccgcccgactcgcacatgtttttgcatattctgccggagggtttgatttctgtgccttcggatttggcgagggcgatttgggtgtcgaaaatgtttttgaaggatgagagtttgtctggtagtgcagggtattcggtgggattgtacaggtggaggtcgtattgttcggtgatgtggtgtatggcgcttccggctatggtggcataccaggtgtggtgttgggcgtggtagccgtgttggaggcgccatttttctccgcattcggcccactgtgacagtgatgagtaggagatgtggcctggatggttgatggttttcggatattgtgctagaggcattacttgtcgcctttgtgggtgttccatgggttgcgggtgtcttggcctgcatcgtgttgctggtaggcaaggagtgcgaggcagtgccaggcagcatgggccagatgcggtagcccggattcatcatcgaggttgttgccttgctgccaggatagcacatggcggtagagggcatcgacactgtggctccacgggtatcctccggtccagttgttgtcgccgtatttggtggcaccgtagcctgcaacctcgcctagggcgtgcaaggctgcggggtcgatgagggagagcctgcagagtttcaattcttttcgggcaccgctgttggggtcggtgtacatgcgggtgggctcatccatgagatgtgtgctccttaagagtgggttactggttgttgtcgtgagctagggcgacggcgagaataatgatggcgagggtttcggctatcaggatgggtgttgtgatcatttagtgtctcggggatggtaggtgagtgttgaggcgcccaggagggtggcgagggcgcatgcggcaataatagcgagggcggctttgtggctggtgccggttgcgtacatccatgtgatgatggcgccttggatccaggcgaggctggtgaagaacgtttcgtagctgtgtagctcaatgttgttgttgggtgtgttcatgcttgctcctgaagaatggtgttgatggttttataaatgttgtacaggtcggtttcgatagataacagttgatggatttcgtggtcgagatcaatgtctgggttgagggtgttgatgcgggaggcaatatcggtggctgtgcggagtgtgccgccggtgtggtgaataatgtgtgccgtgtcggcgaggcctgtggtgacagcgtagcgggagaggagaggcatagcggtccttgacggggttactgttgcgggttgatgttgaggtcggtgacgtgcgggtggtcttctgttccggtgacgaggcagtggacggtgactggtagtttggatgctcccggctggcggacggtggcgccgtagacgatggagaaggtgtctttaccaataattttgtggagttggaggtcgatgtcggggttgccgttccagttgacaccgtgtgcggcggccttctgctcagccttgtcattgcaggcgtgtgctgcggtgatcatggtgagtccggtggcggtttcttctccgcgggcttgggcttgcttgtgggttttggcttgttcggcttgtagggagcgggtggcggctgcctgccgtgccgctttctcggctttgcgctgttgggcggtttttggtgtccattctgtgttggctgtggttacctgtggtgcgggttgtgatgcgagtggggggttgtcgtcgggggctgggaggaaggatgcggcggcgatgatggcggctgtgatgcctgcgatggtgtagccttttttcttgttcatgactgttgtcccctttctggggtgttgttcgttgctgacatgatcaatacttccagtgactggacctcgtgtcaagactgcgctcaaatgttgtgagcgatccttgtgtggctaggggttttatcgggcacacagagtgagtagatggcctacgttgatgcggctcacattccagtagagttgtgtggcttcaccgccggtgagtggcttccactcgttgtggctgaacacggtgccatcggatgcgatgaatgtgttggggcgtagcttgtggagttcaatctctacgctctgccggtaggcttcggcgaggccctcaaaatccatgtggtcgcaggcgaggttttcgaggcgtgtcagatcgaagggtgtggggcagtcgtagctggcgggggtgtagagctgggtgaagtggtcggcaatcttgtgcatgatgatgtccttttcgttgctgataacgttgttgagggtttatcgggtggatgctttgaggatggcgtctacatcgatcatgtcgatgagatcgtggagttcctcagcttcgttctcggagaggtggcgccagttgggtggcccgtatagggcgccgtcgagggtgacagtccacatgggtcggatgagtcgtacggcttcttgtactttagcgtggtacatgcggcgcaccatatcgagatcgatgtcgtctgaatggtttccggtgaggctgtggaggctgagtgggtcgatttctgtctgcctgtagagggatgtgaaggatggggtgatgagtgtgccatccatgggtgatgttcctttctggattgtctgggtgggttgttgtggtttttatggtgtgagggttgtgatccatagtcaaggctgcgctcattcggattgagcgtttcatgctggagtgtctggtgtgacagatgtcacttaagcccttatggtctctctaagcgtctcaaatcttctgggggtaggattatgcagggttgaccctgctaatcgattctagggcccttctagggcgtctcaggggtatgtctgggtgatggcaggttcggtagatgatctagcgagtcaaggtgccgagctgagacataagatctatcatctaggtgtgtgagatgtatcacatcctcctggcttagtgtgcactcccgaggctactctgccgatctgacgtgaagggcgtagcccagaaatgccgtttaaagccttcacacggagcctaggagcgccgtgcagggtgggggctaggtatttatacccccagcacattctgatcgattctagacgcctcccagagcctgatacgcgatcagccatctcggcatagatcatcagcccctatcatggttagctaagcctcaactatgtggacagtgttggatactgtgggggaagaaggacacggtaaaagaaagaggggggagcatcagccttcaagccttaaggtcttagcgcttagcaccgatggtcttagcagttagcaccgagccctctcaagggctcggcatcagcccgaacaggcacagccctgaaaggagtacacgccatcagggaaggcttgagagtacgaggagccctagcgacgagtactcgaaagcctgagggaacaccctcagcactgatggggctagcgtgttcggaaaggacacaagagtgaagtgtgacagctgttcgggagtgaaacccgttctggctaggggtttcagtattaaccaccctcaaaggttacaagactctaagaaaatttaaggaaaagtttaggtttaatttttggacatttactaccaaaaacacccgtttacacccctcaaacccgcctatagagccaaatccaccagtttgactcatcccaggtggtgtatgctaggctggacaggtagccagctggacgcaaggccgaaatccgctgacgcggctttcacccttacatccatcagtctaccaaagacttaaacgcttcaaggctaagcgctaagcccctcagtacttagcaccgagcccttgagggggctcggcatcagtcttaaagctttaaacactttaagtaaacttaagagcttagcacttaaagttaattaataaccttaaaggcttacacacttagcactgagcccttcaaggctcagcatcagtataaagatcttaacacctaagttaagtataaaaccttaaaggcttagcacttaaggatataaacttaacatcagtgtttaagactttaaaacttaaaataactattaagacttaaagacttataagactttaaagaccttaagtacttaaagttaaccatcagtcttaaactttaatattataacctataagtcttaaagcttataggtataataatataatataagttataaaagttttagaagagctaaggggttaacttctttacttctctactctctttggttctttctctcttctcttcttttcttcatcaggggagaagaggaacctttaccgtcaacgctgatgggcttttcaccgtgtgactcgtgtaccaccggtcgcacgctcccggttgcacactctccacactctgacacccgtgtcccttgacggcttggcgtgttcggctcaaggcgtacggcgtgtcacgctaacgcccttaacactaggtaagacttaaagtgtatattatatgtagaagactttaaaaactttagggtgttcctgctgagcctgtgtcctacaccgctaggcgccaagcgctaagccttgaagcgcgaacacccatccacccccatttttctttcgtgcctttcttcttttgacacagctggggggcgatgtgatctttctcacacccatggggggtagtggagaaaacaaccaccccagcacaaacagaacaccccctcaaacgcacaaaacagggcctaggatcgaacagcagggcatcggtagagtattcctacccccaacacgttccaggctgttacaggagcaatgagaggctcacaggggctataggagatcagggggcgtgatggcacacaccaaccgcacagccagccaagctcaccggcgctggcgggcgcgactcatcacccaagcacgcaagcaaggccaaaccgaatgcccactctgcggagccaccatcacctgggacacacacgacctaccaacaagccccgaagccgaccacatcacacccgtcagcaggggaggactcaacaccctagacaacgggcaaatcatctgcagaacatgcaacagaagcaaaggcaacagaacacaaccaaacatcaaactccaacaacaaaccacaaaaacactcgtctcatggtgaaaaaaccgccaacccccaccggggacaccccctgcacaggcgtgcaa

SEQ ID NO: 49 - DNA, 29373 bp, Unknown
  source: /note="Description of Unknown: Bacteriophage of P. acnes"
cccttttgtggattagtctatttgccgactttttgtgttggtggtgagtgttgtgcagcctgagcttcctgggtctcgtgagtggtgtgatgagacacgtcgctggtggcgtgtgtggggtgaggattcgcgtgcgcagtacgtgtctgatgaggagtggctgtttttgctggatgctgctgtgattcatgatgtggtgtggcgtgagggccgggcggaccttgtggcttcgcttcgtgctcatgtgaaggcttttatgggcatgttggatcggtattcggttgatgtggcgtctggtggccgtggtgggggttctgctgtggcgatgattgaccggtataggaagcgcaagggggcctgattaggtgtctagcgttgtggggtcgcaggttcctcgtcatcgtgtggctgcggcgtattcggtgactgctggcggtgatgctggcgagcttggtagggcgtacgggttgacgcctgatccgtggcagcagcaggtgttggatgattggctggctgtcggtggcaatggcaggcttgcttctggtgtgtgtggggtgtttgtgccgcgccagaatggcaagaatgctattttggagattgtggagttgtttaaggcgactattcagggtcgtcgtattttgcatacggctcacgagttgaagtcggctcgtaaggcgtttatgcggttgcgttcgttttttgagaatgagcggcagtttcctgacttgtatcgtatggtgaagtcgattcgggcgacgaatggtcaggaggctattgtgttgcatcatccggattgtgcgacgtttgagaagaagtgtggctgtccgggttggggttcggttgagtttgtggctcgtagccgtggttctgctcgcggttttacggttgatgatttggtgtgtgatgaggctcaggagttgtcggatgagcagttggaggctttgcttcctacggtgtctgcggcgccttctggtgatcctcagcagatttttttggggactcctcctggcccgttggctgacgggtctgtggtgttgcgtttgcgtggtcaggctttgtcgggtggcaaaaggatcgcatggaccgagttttcgattcctgacgagtcggatccggaggatttggcgcggtcgtggcggaagcttgctggtgacactaatccggcgttggggcgtcgcctgaattttgggacagtctcggatgagcatgagtcgatgtctgctgccggttttgctcgggagcgtcttggctggtgggatcgtggccagtctgctacgtctgtgataccggcggataagtgggctcagtcggcggtggatgaggcgagcctggtcggcggtaaagtgtttggtgtctcgttttctcgttctggggatcgggttgctttggcgggtgccggcaagactgatgctggggttcatgttgaggttattgatgggctgtcgggaacgattgttgatggtgtgggccaactggctgattggctggcgttgcgttggggtggcacggatcggattatggttgccgggtctggcgcggtgttgttgcaaaaagcgttgacggatcgtggtgttccgggccgtggcgtggtggttgctgatactggcgtgtatgtggaggcttgtcaggcgtttcttgagggtgtgcgttcgggtgttgtgtctcatcctcgcgctgattctcgccgtgacatgttggatattgctgtgaggtcggctgtgcagaagcgtaaggggtctgcttggggttggggctcctcgtttaaggatggttctgaggttcctttggaggctgtgtcgctggcgtatcttggtgtgaagatggcgaagtctaagcggcgtgagcgtagtggtaggaagcgggtgtctgtggtatgaactcggatgagttggctcttattgagggcatgtacgatcgtatccaaaggttgtcttcgtggcattgtcgcattgagggctactatgagggttcgaatcgtgtccgtgatttgggggttgctattcctcccgagttgcagcgtgtgcagacggtggtgtcgtggcctggtatagctgtggatgctttggaggagcgtctggattggcttggctggacgaatggtgacggctacggcctggatggtgtgtatgctgcgaatcggctttcgacggcttcgtgtgatgtgcatcttgatgcgctgatttttgggttgtcgtttgtggctgttatccctaacggtgatggttcggtgtcggttcgtccgcagtcaccaaagaattgcaccggaaagttttctgccgatggttctcgtctggatgcgggtttggtggttcagtcgacttgtgatcctgaggtggttgaggcggagcttttgcttcctgatgtgattgttcaggttgagcggcggggctcgcgcgagtgggtcgaggttggccgtatcgagaatgtgcttggtgcggttccgcttgtgcctatcgtcaataggcgtcgcacttcgaggattgatggccggtcagagatcacaaggtctattcgtgcttacacggatgaagcggttcgcacgctgcttgggcagtctgtgaatcgtgatttctatgcttacccgcaaaggtgggtgactggtgtgtcggctgacgagttttcgcagcctggctgggtcctgtcgatggcttctgtgtgggctgtggataaggatgatgacggtgacacgccgaatgtggggtcgtttcctgtcaattctcctacaccgtattcggatcagatgcggctgttggcgcagttgactgcgggtgaggcggctgtcccggagcgctatttcgggtttatcacgtctaacccgccgtcgggkgaggcgcttgcggcggaggagtctcggcttgtgaagcgtgctgagcggcgtcaaacgtcgtttggtcagggctggctgtcggttggttttttggctgcgaaagcgcttgattctagtgttgatgaggccgatttttttggtgatgttggtatgcgttggcgtgatgcgtcgacgcctacccgggcggctacggctgatgctgtgacgaagcttgttggtgccggtattcttccggcggattctcggacggtgttggagatgttggggcttgatgatgtgcaggttgaggctgtgatgcgtcatcgtgccgaatcttcggatccgttggcggcgctggctggggctatatcgcgtcaaactaacgaggtttgataggcgatggcttcgggtgttgcgtcgcggatggctgctgccgggtatcagcgtgaggcggtcaggtttgccgggaagtatgcgggctattatgccgagttgggtcgtttgtggcattccgggaagatgacagatgcgcagtatgtgcgtttgtgtgtggagttggagcgtgccggccatgatggttcagcagctatggcgggcaaattcgtgtccgattttcggaagcttaacggkgtcgatcctggtttgattgtgtatgacgagtttgatgctgccgccgcgttggcgaggtcgttttcgactatgaagatgatgaatagtgacccggatagggcgaatgacacgattgatgctatggcggcgggtgttaatcgggctgtcatgaatgctggccgtgacacggttgagtggtctgcgggtgcgcagggtaggtcgtggcgtcgggtgactgatggtgatccgtgcgcgttttgtgccatgttggctacgaggtcggattatacgaccaaagaaagggcactcacttccggtcatactcggcgtcataagcgtggtggtaagcgtccgtttggttcgaagtatcatgatcattgtggttgtacggtggttgaggttgttggcccttgggaaccgaatagggctgatgccgagtatcagaggacgtatgagaaggctcgtgaatgggttgatgatcatgggttgcagcagtcgcctggcaatattttgaaggctatgcgtactgttggcggcatgcgataatttgatgtggtttccggttgtgcgccgccggttattggtgcacagggttgtctcccgcacgggggtcaacaatgttgtgttgttttccgcaaggagtgtaggttaggctatggccgatcagagtggtgaggaacagaatgttgacaatgatgttgtggagcccggaaagggtggagacattgttgatgttgtgaaggatgggcaggctgccggcgatgatcatgccggtgatgtttccgtgaagggtgaggcttctgggccgtctggcacggattggaaggctgaggcccgtaagtgggagtctcgtgctaaaagtaatttcgccgagttggagaagcttcgcgcctcggatggtgatgcgggatctgtgattgatgatcttcgccgcaagaatgaggaactcgaagaccggatcaatgggtttgttcttgagggtgtgaagcgtgatgtggctgccgagtgtggcctgtcggctgatgctgtagctttcttgtctggtggtgatcgtgaagcgctggtggagtctgctaaggctttgaagggtttgatcgaccatagtagtggtggcgtgggtgtgcgccgtcttgcggggagtgcccccgttgatgatgttaaacgacgtgagggtgtcgcgtttgtggatgctcttgtcaataattctaggagatgatttgtgatggctgacgattttctttctgcagggaagcttgagcttcctggttctatgattggtgcggttcgtgaccgtgctatcgattctggtgttttggcgaagctgtcgccggagcagccgactatttttggccctgtgaagggtgccgtgtttagtggtgttcctcgcgccaagattgttggcgagggcgaggttaagccttccgctagcgttggtgtttcggcgtttactgcgcagcctatcaaggttgtgactcagcagcgtgtctcggatgagtttatgtgggctgatgctgattaccgtttgggtgtgcttcaggatctgatttcgcctgctctgggtgcttctattggtcgcgccgtggatttgattgctttccatggtgttgatcctgctacgggtaagcctgctgcggctgtcaaggtgtcgctggataagacgaagaagacggttgatgccacggattctgccacgaccgatcttgttaaggctgtcggccttatcgctggggccggtttgcaggttcctaacggtgttgctttggatccggcgttctcgtttgccctgtctaccgaggtgtatccgaaggggtctccgcttgccggtcagcctatgtatcctgccgccgggttcgctggtttggataattggcgtggcttgagtgttggtgcttcttcgactgtttcgggtgccccggagatgtcgcctgcctctggtgtgaaggctattgttggtgatttctctcgtgttcattgggggttccagcgtaacttcccgatcgaactgatcgagtatggtgatccggatcagactgggcgcgatttgaagggccataatgaggttatggttcgtgccgaggctgttctgtatgtggctatcgagtcgcttgattcgtttgctgttgtgaaggagaaggctgccccgaagcctaatcctccggccgagaactgatttattgtagcggtgttatgtacatgtgcagggggtggtgttgatgggtataattttgaggcctgaggatattgagcctttcgccgatattcctaaagataagcttgaggcgatgatcgccgatgtggaggctgtggctgtcagtgtcgccccctgtatcgctaaaccggatttcaaatacaaggatgctgccaaggctattctgcgtcgtgctttgttgcgttggaatgatactggcgtgtcggggcaagtgcagtatgagtctgcgggtccgttcgcccagactacacggtctaatactcccacgaacttgttgtggccttctgagattgctgcgttgaagaagctatgtgacgagagtggtggcgccggtaaagcgttcactatcacacccaccattaatagtagatatgcacattctgaggtgtgttctactgtgtggggtgagggctgttcgtgcggatctgatattaacggctgcgatggccctttgtgggagatatgatatgactaattttccttacggggaaacggttgtgatgcttcaaccgactgttcgtatcgatgatcttggcgacagggttgaggattggtctaagcctgtcgaaacagtttatcgtaatgtggctatctatgcttccgtttcgcaggaggatgaggcggctggccgtgattcggattatgagcattggacactgcttttcaagcagcctgttgtgggcgctgattatcgttgcaggtggcgtattcggggtgttgtgtgggaggctgacgggtcgcctattgtgtggcatcacccaatgtctggctgggatgctggtacgcagatctatgtgaagcgtaagaagggctgatgaaatcttggcacaagatgtgaatgtgaagctgaacttgccgggtattcgtgaggtgttgaagtcttctggggtgcagtctatgttggctgagcgtggcgagcgtgtcaagcatgcggctgcggcgaatgtgggcggtaatgcttttgatagggcccaatatcgtagcggattatcatcggaggtgcaggttcaccgtgttgaggctgtggtgaggattggcaccacatataagggtggtaaaaggattgaggcgaagcatggcacgttggctaggtcgattggggctgcatcatgatcgtttacggcgatcctcgcgtgtgggctaaacgtgtgctcaaggatgatggttggctgtctgatgtgccgtgcacgggtactgtgcctgaccggtttgagggtgacttgatttggttggcgttggatggtggccccgagttgcatgttcgtgagcaggtgtttttgcgggtgaatgtgttttcggatactccggatcgtgctatgtcgttggcgcgtcgtgttgaggctgtgctggctgatggtgcggatggtgatccggtggtgttttgtaggcgttctactggtcctgatttgttggttgatggtgcacgttttgatgtgtattcgctgtttgagctggtgtgccgtcctgtcgaatccgagtaaacgtatttgttttctatattttgtttttgtttgattattttgggggttatgatggctgcaacacgtaaagcgtctaatgttcgctcggctgttactggcgacgtctatattggtgacgctcacgccggtgacactattaatggtgttggggagattcctgacggtcttaccgctttagggtatctgtctgatgacgggtttaagattaagcctgagcgtaaaacggatgatttgaaggcttggcagaatgcggatgttgttcgcactgtggctaccgagtcgtctatcgagatttctttccagctgatcgagtctaagaaggaggttatcgaactgttttggcagtcgaaggttactgccggagccgattcgggttcattcgatatttctcctggtgccacgacgggtgttcatgccctgttgatggatattgttgatggggatcaggttattcgctactatttccctgaggcggagcttgttgatcgtgacgagatcaagggcaagaatggcgaggtgtacgggtatggtgtgacgttgaaggcgtatcctgcccagattaaccataagggtgatgcggtgtctggtcgggggtggatgacggctttaaaagctgatactcctccggttccgccgaagcctccgaagcctgagccggatcctaatccgccgtccgataactgatacacgagtttaagggattgttgatagatgagtgacactggtttcacgttgaagattggtgaccgtagttgggtgttggctgatgcggaggagacggcgcaggctgttccggcccgtgtttttcgccgtgccgctaagattgcccagtcgggggagtcggctgatttcgcccaggttgaggtgatgttttctatgttggaggctgccgccccagcggatgctgtggaggctttggaggggcttcctatggttcgtgttgccgagattttccgtcagtggatggaatacaagcctgacggtaaaggtgcctctttgggggaatagtttggctccacggcctgattgatgattatcgtggggccatcgaatatgattggaggacacggttcggttgctcggtttatgatgttggtggccccgtaatgtgttacggtgaggctgtccggctggctggcgtgttgtgtacggacacgtctagccagttggcggcccaccttaatggttggcagcgcccgttcgagtggtgcgagtgggctgtgttggacatgttggatcattacaggtctgctaatagtgaggggcagccggagcctgtggcgaggccgactgatgagcgtcgggccaggtttacgtcgtctcaggtggacgatattttggcgcgtgttcgtgccggtggcggggtgtctcgcgagattaatattatggggtgaatagtgtatgtctggtgagattgcttccgcatatgtgtctttgtatacgaagatgcctggtttgaaatcggatgttggtaaacaattgtccggggttatgcctgctgagggtcagcgttcgggtagtctttttgctaagggtatgaagttggctcttggtggcgcggcgatgatgggcgctattagtgtcgctaagaagggcctcaagtctatctatgatgtgactattggtggcggtatagctcgcgctatggctatcgatgaggctcaggctaagttgactggtttgggtcacacgtcttctgacacgtcttcgattatgaattcggctattgaggctgtgactggtacgtcgtatgcgttgggggatgcggcgtctacggctgccgcgttgtcggcttctggtgtgaagtctggcggtcagatgactgatgtgttgaagactgtcgcggatgtgtcttatatttcgggtaagtcgtttcaggatacgggcgctatttttacgtctgttatggctcgcggtaagttgcagggcgatgacatgttgcagcttactatggctggcgttccggtgttgtctctgttggctcggcagacgggtaaaacttcggctgaggtgtcgcagatggtgtcgaaggggcagattgattttgccacgtttgcggctgcgatgaagcttggcatgggtggtgctgcgcaggcgtctggcaagacgtttgagggcgctatgaagaatgttaagggcgctttgggctatcttggtgctacggctatggccccgtttcttaacggtttgcggcagatttttgttgcgttgaatccggttatcaagtcggtgacggattctgtgaagcctttgtttgcttctgttgatcagggtattcagcgggtgatgccgtctattttggcgtggattaatcgtatgcctgctatgattacgagaatgaatgcacagatgcgcgccaaggttgagcagttgaagggcatttttgcgagaatgcatttgcctgtccccaaggtgaatttgggtgccatgtttgctggcggcaccgcggtgtttggtattgttgccgcgggtgttgggaagcttgtggcagggtttgccccgttggcggttgcgttgaagaatttgttaccatcgttcggtgctttaaggggtgccgctggcggtcttggcggcgtgtttcgtgccctgggtggccctgtcgggattgtgatcggcttgtttgctgccatgtttgctacgaacgcccagttccgtgcagctgttatgcagctggttggtgtggttggtcaggctttggggcagattatggccgctattcagccgctgtttggtttggttgctgggctggtggcccggttggcgccagtgtttgcccagattattggcatggttgccgggcttgcggcacagcttatgcctgtgattagtatgcttgttgccaggctggttcctgtgatcacgcagattattggtgcggtgacacaggttgctgcaatgttgttgccggcgttgatgccggtgttgcaggctgttgtggctgtgattcggcaggttgttggcgtgattatgcagcttgtgcctgttttgatgcctgtgattcaacagatcttgggtgctgttatgtctgttctgccgccgattattggtttgatacggtcgctgataccagtcatcatgtcgattatgcgtgtggtgatgcaggttgttggtgtcgtgctacaagttgttgcccgtattattccggttgtggcgccgattgtgacagctgtgatcgggtttgttgcacgtattcttggtgctattgtgtcggctgccgccaggattattggggctgttgcccgtgttattgggtgggttgtgagccatctggtgtctggtgtggcgcgtatgggttcggctatccaggctggctggaatcatattagggcgtttacgtctgcgtttattaacggtttcaagtcgatcatttcgggtggtgtgaacgcggttgtggggttttttgcccggctgggttcgtcggttgccagccatgtgaggtctgggtttaatgctgccaggggtgctgtttcttccgccatgaacgggatacgtagtgtggtgtcttcggtggcgtctgctgttggcgggtttttcgggtcgatggcgtctagggttcggaatggcgctgtgcgcgggtttaatggggctaggagtgcggcctcttctgctatgcacgctatgggctcggctgtgtctagcggtgtgcataatgtgttgaattttttccgtaatttgcctggtaatattaggcgtgcgcttggtaatatggggtctttgttggtgtctgctggccgtgatgtggtgtctggtttgggtaatggtatccggaatgctttgagtggcttgttggatacggtgcgtaatatgggttctcaggttgctaatgcggcgaagtcggtgttgggtattcattcgccgtcgagggtgtttcgtgacgaggttggtcggcaggttgttgctggtttggctgagggtattactggtaatgctggtttggcgttggatgctatgtctggtgtggctggccggcttccggatgctgtggatgccaggtttggtgtgcgatcgtctgtgggctcgtttacaccgtatggcaggtatcagcgtatgaacgagaagagtgttgtggtgaatgttaacggcccgacgtatggggatcctaacgagtttgcgaagcggattgagcggcagcagcgtgacgcgttgaacgcgttggcttacgtgtgattgggggtgtggatcatgtttattcctgacccgtctgatcgtgccggtttgactgttacctggtctatgttgccgttgattggtaatgatccggagcgtgtgcttcatttgacggattacacgggtgcgtctcctgtcatgttgttgaatgattcgttgcgcggtttgggtgttcctgaggtggagcatttttctcaaactcatgttggggtgcacggctcggagtggcgcgggtttaatgtgaagcctcgcgaggtgacgctgccggtgctggtgtcgggtgttgacccggatccggatggtgggtttcgtgacggttttttgaaggcgtatgacgagttgtggtctgcttttcctcctggcgaggtgggggagttgtctgtgaagactcctgccggtgttgagcgtgtgctaaggtgtcggtttgattcggtggatgacacgtttactgttgatccggttaatcgtggctatgcgcgttatgtgcttcatttgacagcctatgacccgttttggtatggggatgagcaaaagtttcgtttcagtaatgcgaagttgcaggattggttgggtggcggccctgttaataagaagggtaccgcttttccggtggtgttgacgcctggtgttggttcgggttgggataacctgtcgaataagggtgatgtgcctgcgtggcctgtgattcgtgttgagggcccgttggattcgtggtctgtgcagattgatggtttgcgtgtgtcatcagactatcctgtcgaggagtttgattggattactattgacacggatcctcggaagcagtctgcattgttgaacgggtttgaggatgtgatggatcgtttaaaggagtgggagtttgcgccgattcctcctggcggttctcggagtgtgaatattgagatggttggtttgggtgccattgttgtgtcagtgcagtacaggtttttgagggcttggtgaatagtttatggctggtcttgtcccgcagataacattgtttacgccagactatcatcgtgtagcgcctatcaatttttttgagtcgctgaagttgtcgttgaagtggaatggtttgtcgacgctggagttggtggtgtctggtgatcattccaggcttgacgggttgactaagccgggtgcacgcctggttgttgattatggtggtggccagattttttctgggcctgtgcgtaaagtgcacggggttgggccttggcggtcttcgcgggtgactatcacgtgtgaggatgatattcgcctgttgtggcgtatgttgatgtggccggtgaattatcgtcccggtttggttggttcggagtggcgtgcggaccgtgattatgcccactattctggtgcggcggagtcgattgctaagcaggtgttgggggataatgcttggcggtttccacccggtttgtttatgaccgatgatgagcgtcgcggccgctatattaaggattttcaggtgcggtttcacgtgtttgccgataaactgttgccggtgttgtcgtgggctcgtatgactgtttcggtgaaccagtttgaggatgcgaagtttgatcagcgtggtttagtgtttgattgtgtgcctgcggtgacgcgtagtcacgtgttgactgccgagtctggttcgattgtgtcgtgggagtatgtgcgtgacgcccctaaggcgacgtctgtggttgtgggtggccgcggcgagggcagggatcggctgttttgtgaggatgttgattcggctgccgaggaggattggtgggatcgtgtcgaggtgtttaaggatgctcgtaacactgattcggagaaggtgtctctcttcgatgaggctgagcaggtgttgtccgagttgggggccacgtcggggtttaagatcgagttggctgagtcggatgtgttgcgtttcgggcctggcagcctgatgcctggggatttgatttatgtggatgtgggctcggggcctattgcggagattgttcggcagattgatgtggagtgcgattcgcctggtgacgggtggacgaaagtaacaccgattgcgggggattatgaggataatccttcagcgttgctagctcgccgtgtggctggtttggctgctggtgtgcgggatttgcaaaaattctagttgattggggtttgttgtgggtattgtgtgtaaagggtttgatggtgtgttaaccgagtatgattgggctcaaatgtctggtctgatgggtaatatgccgtcggtgaaggggcctgacgattttcgtgtcggcacgacgattcagggtaatacggtgttgtgtgaggtcctaccggggcaggcttgggctcacggggtgatgtgcacgtcgaatagtgttgagacggtgacaggccagttgccgggccctggggagacccgctacgactatgttgtcctgtcgcgggattgggagcagaacacagcgaagttggagattgttcctgggggtcgtgcggagcgtgcccgtgacgtgttgagggccgagcctggcgtgtaccatcagcagttgttggcgactttggtggtgtcgtctaacgggttgcagcagcagttggataggcgtgctatagcggctagggtggcgtttggcgagtctgctgcgtgtgaccctaccccgatggagggtgacagggtgatggttccttctggggcggtgtgggctaatcatgccggcgagtggatgctattgtcccccaggatcgagacgggcactaagcagattcagttttgcgggtctgctgtgtatgcttacacgatcccgtttgaccgccagttcactagtccgccgattgtggtggcgtctatgggaaccgctgctgggggcactgcccagattgatgtgaaagcctacaatattacggtcaagggtttcagtttagcgtttatcacgaatgatggttcgaagccgaatggtgtgcccgcgatagctaactggatagctgtcggcgtgtgaccgtgtcgaggctgtggcggatggtgtgatgttggggggctgtggtgtcgtggtttactcctgcactggtggcctctatttgtaccgcgttggccacgattttgggttctgttcaggcggtcacgtttaaatcgaggaagcgtttgcgtcggctgtcggctcaggtggatgctttggaagagtatgtgtggggtgtgcggcgtaaggttcgccggtttaacgccgggcttcctggcgaggtggagcctatgcatcttcctgatgtgcccgagtttttgaaggatactgttgatggtgggggtgagtagggttgagggagttggaggaagaaaaaaggcagcgccgcaattttgagaaggcttccctaatactgttgttcctgtcgcttgtgctgttgatggtggttgctgcgggtgctttgcgtttcggatcgctgtcttctgagcgggattcggagcaggcgagggcccagtctaatggtaccgctgccaggggtttagccagccgtgtgcggcaggtgtgtgcgcatggtggccaagagtcggtgaagctgcacaggtctggtttgtgtgtggatgctgtgcgcacggagcggagtgtgcagggtgtgcctggcccgaccggtgtacggggcccgcaaggccctgccggtgttgatggccgggatggtgttaatggtttgcctgggctggttggccctgttggtccgcagggttccccgggtttgaatggcgtgaaggggcctgacgggctgcctgggactaatgggtcggatggccatgatggtgtttcgggcagtgcaggtgccgctggtgtaaacggcgctgatggtaaagatggcgcgaatggcaccgatggtgagcgcggtgatgtgggtccttcaggccctgccggcccgcaaggtgcacagggtgaacggggtgagcgcggtgccgctggtgtaaacggcgctgatggtaaagatggcgcgaatggccgttctgtggtgtctgtgtactgttccgggggccgcctgatggtgaaatatagtgacggtgtggcttctaccatatcgggctcggtggcctgccagggtgtggatccgtctcctatagtgaccatatcatcccacaaataatatgaagagggaagggtgttactagtgttggttgtgtttggtggtggtgtgtggtgagatacattcctgcggcgcatcattcggccggctcaaatagtccggtgaatagggttgtgattcatgcgacgtgtccggatgtggggtttccgtctgcctcgcgtaaagggcgggcggtgtctacggcaaattattttgcttccccatcatctgggggttctgcgcattatgtgtgtgatgtgggggagacggtgcagtgcttgtctgagtctacgattggttggcatgccccgccgaatccgcatagtttgggtatagagatttgcgcggatgggggttcgcatgcctcgtttagggtgcccggtcatgcttacacgagggagcagtggctggatcctcgggtgtggcctgcggtggagaaggctgctgtcctgtgccggcagttgtgtgacaaatataatgttccgaaaaggaagcttagtgcagccgatttgaaggctggtaggcggggtgtgtgcggccacactgatgtgacggatgcgtggcatcagtcggatcatgacgatccggggccgtggtttccgtgggacaaatttatggccgtagtctgcggcggtagtggtagtgaggagttaactgtggctgatgtgaaagccttgcatgatcagattaaacaattgtctgctcagcttactggttcggtgaataagctgcaccacgatgttggtgtggttcaggtgcagaatggtgatttgggtaagcgtgttgacgctttgtcgtgggtgaagaatcctgtgacggggaagctgtggcgtactaaggatgctttgtggagtgtctggtattacgtgctggagtgtcgcagccgtcttgccaggcttgaggcggatgtggcccggttgaagaagtgatgtgtgatgggtaaacagttttggttgggcttgtttgagcgtgccctgaaaacttttattcaaacgtttgttgctgtgttgggggttactgcgggtgtcacttatactgcggagtcgtttcgtggtttgccgtgggagtctgccctgattacggccggggtggctgctgtcctgtcggttgctacctcgtttggtaatccgtcgtttgtggccggtaaacctaaaacggcgcctgttgtggatgctgggcttgttccacccgatgatgggggcttggttgagcctcactcggtggatgtgtcggatcctggcatgatcgagccgttggatgatgagagtgtagactatgtgccgaggcgtgccgccgagtctgaggttggcacggtagagtctactgttgcataattgaatatgtgtgtgtgccccagcggtgctgccacgatcgtgtggtggttaccgctggggcactatttctgtatatacggtgtggctatgattcgttgttgttgatggtttcctcaatcgtctgatacaggtggaggcaggtagagatagtttcgttggcctggtctagaatgttctggccgataacatttttatggttgtcgcggtgacaggtgatagaccacaggatctcgtcggccgtcgcttgcaatagtttgacctggtatgcgattccggcgagccagtctagtgcttccgggcttgcctgtgtgtcgtctagcatgccactattgttgctgttgtttgtggggtatcctgcactgtcgcagcaccataggatttcgctgcactcgtctagcgtgtcctgatcgatagcaagatcgtcgaggctgacttctttaacggtaaggttcacgtcatcgagtgagatgggtacacggtacttgttttccaactgttgcatgttggtgggctgttgttggatgattcggtgtactactgttttgagggccgtgtaggggatattgtgtgtggtgttcatggttttatctcatccctgtgatgtcgtcactatcgtctggatagtatctactgtttgcgtagcctgttagggtgatgagtgtttggtcggcccactgtttcacagtctgccgggtgactccgagtcgttgggctgccaccgaataggtttggtcatacccgtatacttcacggaatgctgccaaccgtgccaaatgttttcgctgtttggatggctggcaggagagggtgtagtcgtcgatggctagctgcaggtcgatcatggagacgatgttgttgccgtggtgttgtggcgcggttggtgggggtggcatgcccggctccmcgcgcggtttccatgggccgccgttccagatccattgggcggcttggatgatgtcggcggtggtgtaggttcggttcattggtcatcccctgaataggttgtcgaggttgtctgggttgctggtgtcgaatcgtcccacacagtggcagtagtcgtacatgagtttgataatgtgttggtggtcgccgaggtaggtgtttccgctgatactgtaggtggctgtgccgtctttgctgatgctgtatttggcggtgatggtttcgggtgtttcggtgttggtgatgatggctgtggtggtggtgcctacggtttgtagcactgtggtttgggttccgtcgtcgagggtggttgtgaccattgtggttttccttaaatgcttgtctggttgtcggctatagtggtgatttctggtactggtttgggtagatctaggtgttgtgtagccttgttggctaaacgttgggctacacggtagcacatttggatccacgggttgtcttgtagctggtggtattggttgcgtacggctatgtagaggagtgcgtcttgatagaggtcgtctgggttgatggccggatagcggcgtgcagtgttgctacaagctttgtgtagctggtgttgatggttgggggttgcccattcccagttggctgtggtggcttgctgtactttggttggccgtctgctcatggcactatttcatctcgctatctgatagttgtttggtgttttgttgtttatagtgtagcacactagtccggggtggccggtggtgcctgtgcggtgccgaaaccatgtggattcgccttccatggatgggcattggatgaaggtgcgttgtccttgctcggagatttctagatggtgccggtgcccggccatgagaatactagatacggtgccgttgtggaattcttggccgcgccaccattcgtactgtttgccggtgcgccattggtggccgtgggcgtgcaagatttgtgtgcctgccacatcgacggtggtggtcatttcgtctcggctggggaagtggaagtgaaggttggggtattggttgttgagctggtaggcttctgcgatggcccggcagcagtccacgtcgaaggaatcatcgtaggtggtgacgcctttaccgaagcgcactgcttcgccgtggttgccggggatggatgtgatggtgacgttggcgcagtggtcgaacaggtggacgagttgcatcatggccatgcgggtgagcctgatttgttccgttaagggtgtttgtgtgcgccacgcgttagagccgccttgtgacacgtatccttcgatcatgtcgccgaggaatgcgatgtggacccgttcgggtttgcctgcctgttgccagtagtgttttgcgactatgagggagtgtaggtagtcgtctgcgaatcggctggtttctcctccggggatgcctttgcctatttggaagtcgcctgccccgatgacgaaagcagtgttgttgctgcttgtgttggtttctggtttgggcggctgccagtcggctaatttgttgacgagttcgtcgatcgggtatgggtctgttgcgggttggtggtcgattattttttgtacggatcggcctgtttctccgttggggagtgtccattcggagatgcgtgtgcggcgtacggtgccgtttgtgagatcatcgtcgatggtgtcgatggcgttgttgtggttggctagctgtgtgaggagccggtcaatattgtctatcactggttttcctcctcctgtttctgggtgtttgtgagttggcggcgatagtctttaataacagtggcggagattgggtatccggcttgggtgagctgttttgctagccatgaggcgggaatggttttgtctgcgagcacgtctgcagccttgttgccgtagcgttgaataagggttttagttttggttgccatgatatcctaggggttgtgtggcgggctgccatcctgtgcggcagtcgccgtcgtgtcctggtttacgggtgcaccatgtgatggtgccgtctgtgtggttgagtgtttttccgcacatgacgttttgtagatgctccggcagctggtcggtgttgttgctggtttgtgtgtcgaagagtgttttctggttggtgaaatgctctgacacggtgccattatgtacgggtagtatccatgttttccattgttgttgtagccgggtgttccagtggaattgtttggcggcgttttctgcctgttttaaggttttgtagtagccgactagtatgcgctggtgttcactgtcgggcgggttttggcctcgccagtattgtgccgcgatggcgtaccggttgctggatgtaaaggtgttccagcagtattcaataatgtgttgcaacatactgtctggcaggctgtcggggttgatggtggtgttttgggcaatgatgccgcggatggcttgccggtttttggtggtgggtttgaacgagatgctcacgatagtgccggctggtcgtcttgcatgaactggttgaaggtgttgttaccggcgtgttgggcttgtgtgatgtcctggtcggtccagtcggggtgttgctgtttcagatagtaccagtggcacgcatcgtaggtttcgtcttgtagccgtgtgagatggttttcggtgatgatttgtttccacattgtccatgacacgttgagccgtttgagcatgtctatggctggcacgttgaaggagttgaggaacaggatttcgtgggtgtagtattccttctcgtattggtcccatccacttcggtgcctgttgggctggtttttggggtaggcttcccggcatactttgtgcaaacgcttggccatgtcgtcgggtagtttaatgtcggggttggcgcggatcatggatctcatcccgtcataggtggtgccccaggtgtgcatgatgtaggtggggtcttctccgtcggcccatttttctgcacagatggcgaggcggatgcgcctcctggatgcttggctggtgttgcgccggccggggatggggcacgtgtcgaggggatccatgatgttttagtgtacctttcttgaggtgatgtttgtttactttgtgtggttttattgtagcacagtgtctagtgcttgtgtcaaccctgtttttccggcctgcaggtaggtgtctgtgacatccccgacagtgaggggcacgtgtacggcttgggggagtgccgtctggagggtttgggccatcttgtctcctgctttgtctgggtcggaccagatgtagatgtggtcgtagccttcaaaaaatttggtccaaaagttttgccacgaggttgcgccggggatggctacggccgaccatccgcattgttcgaggatcatggagtcgaattcgccttcgcaaatgtgcatttcggctgccgggttggccatggcggccatgttgtagatggagcctgtgtcccctgccggtgtcaaatatttggggtggttgtgggttttgcagtcgtgcgggagtgagcagcggaaacgcatttttcgtatttcggctgggccgccccagacggggtacatgtatgggatggtgatgcactggttgtagtcttcgtggcctggtatggggtcattgtcgatgtatccaaggtggtggtagcgggctgtttcttcgctgacgcctcttgccgagagaaggtcgagtatgttttcgaggtgggtttcgtagagggccgaggctttctggattcggcggcgttccgcaatgttgtatgggcgtatgctgtcgtacattcgggttttcttcttctaatcgttgttgtagtttggcgaggcctcctccgacaccgcatgtgtggcagtaccagacgcccttgtcgaggttgatgctcatggagggctggtggtcgtcgtggaacgggcagaggatgtgttgctcgttcctggacggattgtaccgtatgtggtaggtgtcgaggaggcggcgggtgtcagaggtgtgggaggagctcgttgagggttgataccacataggcttcgctccatggcttgttgcgctgtttcatcactacgagtccgatggtggactggttttcgcggtttcggtgtgtttcgtagttgcgtgcctcccggctggcttgtttcacgaattcggcgaggtggggttgtcccgctttcgcctcgatcacataggttttatggccggttgtgaggatgaggtcgccttcatcctctttaccgttgaggtggaggcgttctatatcatggccggtgtcgcgtagctggtggaggagtcgtgtttcccattcggctccggcccgccggtttcttgattgttgtgtcgacatgatagtcctttgtgtgttgtggtcatgttccatggctgtttttcggtgaggggcccgaagaatgtgtattcggggtaggctcgtaaccgttcgtatcgggtgccgtcggggctggatttgcctgtgcgctgtttcaacactgcgatgcgcgcctcggccggtatcgtgagcccgttgccattatcctcaccaccatacaatgatactccgaggatgagttgtggtttttctgagaggccgtttttgatttctcgccgtgctggcgggtgttcgatgtcggagccggttttgtctgttgcgtggtgggtgacgatgatggtggagccagtatccctgcccaatgctgtgatccattgcatggcttcttgctgtgcctggtagtcactctcgcagtcttggatgtccatcaggttgtcgataacgatgatgggtgggaaggtgttccacatttccatgtaggcttgcaactccatggtgatgtctgtccatgtgatgggtgactggaaggagaatgtgatgtgttcgccgtggtggatgctgtctcgatagtattctggcccgtagtcgtcgatgttgtgttgtatctgggcggtggtgtgttgggtgttgagtgagatgattcgtgtggaggcctcccagggtgtcatgtcccctgatatgtagagggcgggctggttgagcatggctgtgatgaacattgctagcccggatttttggctgccggaccgccccgcaatcataacgagatcccctttgtggatgtgcatgtccaggttgcggtagaggggttctagctggggtatgcggggcagttcggcagcggtttgggaggctctctcgaaggatcgttgtagagagagcatcggaaccttatctatctatcggttggatgtgtattggtggtcagatggagtcgatatcgatgtcagtagaggctgtggtgtcgtctagctggccgttatcgcgcttgtctacgtattcggcaactttatcatagatggcgtcgtctaatggtttgagcacgaccgcgttgaacccgtttttggtgcgtacggtggcgagtttgaaggcctgctcctcgccaaggtatgcttctagatcgcggatcatggagtgtgggcgatcattgttgcctcgcactttttcgatgatggcgttggggatggtttctggggtgccgttgttgagatcgtctagtgtgtggaagatggtgacatcagcgtagatgcgatcggctgtctgtccaccgtagccttcggtgttgtgttctacgtcgtgcactttgaaggcgatggcggtggcgtcctggtttcgggaggggttgaagaaggtgctgttgctgttgttgcggtagtttgcgagtcccattgttgtttccttttactgttttgttggtttgtgtcggtttttatcgggtgaggctgtttcgtttgctgcggaaagcctcggaaacgtcactgttactggtgatgatcttcttgtactgtttcagaaggtcggctagctgtgccttgcttgttgcattgttgattttgtcgatgacgatactgttttctttggatgcgatgttgtccacgtagtctttggcggcctggttgtatcggtcttggaggatgatggatgcgctcgctactagtgttgcgagatcccagtctttggacacgtcatcgtttttgagtccgcctagcaggtcgatgatggcctgttttgtctgctctgctgtgtctcctcggatgaccgcccatggtgcagcatagtctccaccatatttgagtgtgatcgtgagtcgatcattgtcgatcttgtctttatcggtcatttggtgtccttttctttattgtctgtttctggtggctgtacggtggattctaccgggtatctgtacgagtttttgccgttgacggcccagcatgcgtccttgacggggcagcctttacagagtgttgtgacgtgtgggacgaagatgccttcgctgattcctttcattgcttgactgtacatggatgatacatgccggtaggtgttgttgtcaaggtcgtagagttcggtggatgtgccttgtgtcggggacttgtcgtcgttgcggctggtggctggcgtccaaaacatgccttttgtcacatcgttgccgtgttggttgagcatgtaccggtaggtgtgcagctgcatgctgtcggcgggtaggcgtccggttttgaggtcgaggatgaaggtttcaccggtgtcggtgtcggtgaaaacgcggtcgatgtagccgacaatagtggttccgtcatcgaggatggtttctacagggtattcgatgcctggctggccgtcaataacagcggtagcgtattctgggtggttgcgcctccatgttttccaccggtcaacaaaggtttgaccgtaaaccatccaccagtcgtagtctttcttgtgtggcccgcccgactcgcacaggtttttgcacactctgccggagggtttgatttctgtgccttcggattcggcgagggcgacttgggtgtcgaaaatgtttttaaaggatgcgagtttgtctggcagtgcagggtattcggcggggttgtacaggtggaggtcgtattgttcggtgatgtggtgtatggcgcttccggcgatggtggcgtaccaggtgtggtgttgggcgtggtagccgtgggataggcgccatttttctccacactcggcccactgggtgagtgaactgtaggagatgtggcctggatggtggatggttttcgggtattgtgctagaggcattacttgtcgcctttgtgggtgttccaggggtttcgggtgtcttggccggcatcgtgttgctggtatgcgaggagtgcgaggcagtgccaggcagcatgggctagatgcggtagcccggattcgcggtcgaggttgttgccttgctgccatgatagcacatggcggtagagggcgtcaacgctgtggctccacgggtatcctccggtccagttgttgtcgccgtatttggtggcaccgtatccggcaacctcgcctagggcgtgcaaggctgtagggtcgatgagggagagcctgcaaagtttcaattcttttcgggcaccggtgttggggtcggtgtacatgcgggtgggctcatccatggtgcgtgtgctccttaagcgtgggttactggttgttgtcgtgggctagggcgacggcgagaataatgatggcgagggtttcagctatcaggatgggtgttgtgatcatttgtggtttttgggatggtaggtgagggttgatgcacctaggagggtggcgagggcgcatgcggcgatgatggcgagggctgccttgtgtggggtgccggttgcgtacatccatgtgatgatggcgccttggatccaggcgagactggtgaagaacgtttcgtaactgtgtagctcaatgttgttgttgggtgtgttcatgcttgctcctgaagaatggtgttgatggttttataaatgttgtacaggtcggtttcgatagataacagttggttgatttggtggtcgagatcaatgtctgggttgagttggttgatgcgggatgcaatatcggtggctgtgcgtagtgtgccgccggtgtggtgaataatgtgcgccgtgtcggcgagtccggtggtgacagcgtagtgggagaggagaggcatagcggggatgctccttggcgggttactgttgcgggttgatgttgaggtcggtgacgtgcgggtggtcttctgttccggtgacgaggcagtggacggtgacgggtagtttggatgctcccggctgtttcattgttgcgccgtagacgatgctgaaggtgtctttgccaataattttgtggagttggaggtcgatgtcggggttgccgttccatttaacgccttgtgctgctgctttctgttcggctttccggtcgcaggtgtgggctgcggtgatcatggtgagtccggtggaggtttcttcaccccttgcctgggcttgcttgtgggttttagtctgttcggcttgtagggagcggactgcggcggcctggcgggccttcttctcggctttgcgctgttggacggttttgggtgtccattcggtgttggctgtggtggcctgtggggctggctgtgaggcgagtggcggattatcgtcgggtgctgggaggaaagagcatgcggcgatgatggcggctgtgattccggcgatggtgtagccgtttttcttgttcatgactgttgtcccctttccggggtgttgttcgttgctgacatgatcaatacttccagtgactggacctcatgtcaaggctgcgctcaactattgtgagcgtttcttgtgtggcttggggttttatcgggcgcatagggtgagtaggtggccaacattgatgcgtgtcacgttccagtagagttgtgtggcttcaccgccggtgagcggcttccactcatcatggctgaacacggtgccgtcggtggctatgaatgtgttggggcgtagcttgtggagttcagtctctacgctctgccggtaggcttcggcgaggccctcaaaatccatgtggtcgcaggagaggttttcgaggcgtgtcaggtcgaagggtgtggggcagtcgtagctggcgggggtgtagagctgggtgaagtgatcggcgatcttttgcatcatgattccttttctagtgtggtgggttgatagttttatcgggtggatgcgacaaggatggcgtctacgtcgatcatgtcgatgagatcgtgaagttcctcggcctcattctcggtgagtggctgccagtctcgtggcccgtatatggctccgtcgagggtgacagtccacaggggccggatgagccggatggcttcttcgactttggcacggtataggcggcagatgatagacgtgtgggtgttgcctatgtcacatcctgccaggtgtgcggggtggagtgggttgatttctgtctgcccgtagaggctggtgaatgatggtgtgatgagtgtgccatccatgggagtgctcctttcggtggtgtaggggttgttgtggtttctagagtgtgcgggctgcgaccctacagtcaaggctgcgctcattcggattgagtgtttcatgctggagtgtcgggcgtgaccagatgtcactgaagcctttatggcctctctcagcgtctcaaatcttctaggggtaggattatgcagggttgaccctgctgatcgattctaggggcctttacgtgcgtctcaggggtatgtctgggtgatagcaggtgtggcagatggcccggaaggtcgagataggtctgcatcgcaacgtttggggtgtcatatctgaatattggatctacaccctcatgctgtgtgagataggtcacactcgcctagcgtggtgtgcactctcgaggccactctgccgatctaacgtagagggtgtagcccagaaatgccatttaaagccttcacatggcgcctaggagcgccttatagggtgggggctaggtatttatacccccagcatattctgatcgattctagacgcttccaggagcctgatgcacgatcaaccatctcggcatagatcatcagcccctatcccgcttagctaagcctcaactatgtggacagtgttggatgctgtgggggaagaaggacacagtagaagaaagaagggggagcatcagtcttaacacctgaggtacttaagttaaccttaggatcttagcactgatgggcttaacgcttagcaccgagcccttgaggggctcggcatcagcccgagcaggcacagtcctgaaaggggtacacgccatcagggaaggcttgagagtacgaggagcctcagcgacgagtactcgaaagcctgagggaacacccttagcactgacaggcctagcgtgttcggaaaggacacaggggtacagtgtgacagctgtccgggagtgaaacccgttctggctaggggtttcagccttaaccacctgtaaaggttacaagactctaagaaaatttaaggaaacttttaggttttatttttggacctttaccaccaaaaacacccgtttacacccctcaaacccgcctatagagccaaacaccggtgttgagggtatctctacctagtgtgataggctggacaggtagccagctggacgcaaggccgaaatccgctgacgcggctttcaccctcacatccatcagtctaccaaacactttaaagcttcaaggctaagcgctaagcccttaagaccttaacgcttagcaccgagcccctcaagggctcggcatcagtcctaagagctaagcccttaaggatctaagttattataaaagctttaaagtcttaaagtaaatatataaccttaacagttaaacgtttaaagctttaaaccttaacacctaagttaattataaaaccttaaaggcttagcacttaaggatataaacttaacatcagtgtttaagacttaaagacttataagctttaaacacttaaagtaactctaagactttaaaaaccttaagtacttaaagttaaccatcagtcttaaactttaatattataacctataagtcttaaagcttataaattataaaagttttagaagagctaagagattaacttctttacttctcttctctctttggttctttctctcttctcttcttttcttcatcaggggagaagaggaaccttttaccgtcaacgccgatgggctttcaccgtgtgactcgtgtgcttctggtcgcaagctcccatcgcacactccccacacggtgacacctgtgtccctttcaagcttagcgtgttcggctgaaggtgtacggcgtgtcacgctaacacccttaacaccaggtaagacttaaagtgtatattatatgtagaagactttaaaacctataaggtgttcctgcttagcctgtgtccttcaacgctaggcgccaaacgctaagccttgaaacgcgaacacacacccacccccatttttctttcgtgtccttcttcttttgacacagccgggggggtagtggagaaaacaaacaccccaccacgttcaagacaccccctcaaacgcacaaaacagcccctagaatcgaacggcagggcaagggcaaggtattcatacccccagacgattccaggccgttacaggggccataggtgaataggggacgtaatggcacacaccaaccgcaccgcatctgcctcacaccggcgctggcggcaacgactcatcacccaagcccggcagcaaggccaaaccgaatgcccactctgcggagtcatcatcacctggaacacacacgacctgccaacaagccccgaagccgaccacatcacacccgttagcaggggaggactcaacaccctcgacaacgggcaaatcatctgcagaacatgcaacagaagcaaaggcaacagaacacaaccaaacattcaattccaacaacaaaccacaaaaacattgattccatggtgacaaacccgccaacccccaccggggacaccccctgcacacc

SEQ ID NO: 50 - DNA, 29424 bp, Unknown
  source: /note="Description of Unknown: Bacteriophage of P. acnes"
gcttagtgaaatacctcccttttgtggattagtctatttgtcgacattttgtgttggtggtgagtgtggtgcagcctgagcttcctgatagtcgtgattggtgtggggagacgcgtcgttggtggcgtgtgtggggtgaggatagtcgcgcgcagtacgtgtctgatgaggagtggctgtttctcatggatgctgcggtgattcatgatgtggtgtggcgtgggggtcgtgctgatttggtggcttcgcttcgtgctcatgtgaaggcgtttatgggcatgttggataggtattcggttgatgtggcgtctggtggtcgcggtaatggttctgctgtggcgatgattgacaggtacaggaagcgtaaaggggcctaatgtctagcgttgttggttctcaggttccgcgtcatcgtgttgctgcggcgtattcggtgactgctggcggggatgctggggagcttgggcgtgcgtatgggttgacgcctgatccgtggcagcagcaggtgttggatgattggcttgcggtcggcggtaatggtcgtcttgcttctggtgtgtgtggggtgtttgttccgcggcagaatggcaagaatgcgatccttgaggttgtggagttgtttaaggcgactattcagggtcgccgtattttgcatacggctcacgagttgaagtcggctcgtaaggcgtttatgcggttgcgttcgttttttgagaatgagcggcagtttcctgacttgtatcgtatggtgaagtcgatcagggcgacgaatggccaggaggctattgtgttgcatcatccggattgtgccacgtttgagcgtaagtgtggttgtccgggttggggttctgtcgagtttgtggctcgtagccggggttcggctcgcgggtttactgttgatgatttggtgtgtgatgaggctcaggagttgtcggatgagcagttggaggctttgcttcctacagtaagcgctgctccgtcgggtgatccgcagcagatttttttgggtactccgccggggccgttggcggacgggtctgtggtgttgcgtcttcgtgggcaggctttgtcgggtggtaaaaggtttgcgtggacggagttttcgattccggatgagtctgatccggatgatgtgtcgcggcagtggcggaagttggcgggggagactaatccggcgttgggtcgccgcctgaattttgggacagtatcggatgagcatgagtctatgtctgcggccggttttgcgcgggagcggcttggctggtgggatcgtggccagtctgctacgtctgtgattccggccgataagtgggctcagtctgctgtggatgaggcgagtctggtgggcgggaaagtgtttggtgtttcgttttctcgttctggggatcgggttgctttagcgggtgccggccggactgatgctggggttcatgttgaggttattgatggactgtcgggaacgattgttgatggtgtgggccggttggctgactggttggcggttcgttggggtgacactgaccggatcatggttgccgggtctggtgcggtgttgttgcagaaagcgttgacggatcgtggtattccgggccgtggcgtggtggttgcggatactggcacctatgtggagtcttgtcaggcgtttttggagggtgtcaggtctggtgttgtgtctcaccctagggctgattctcgccgtgacatgttggatattgctgtgaggtcggctgtgcagaagcgtaaagggtctgcgtggggttggggttcctcgtttaaggatggttctgaggttcctttggaggctgtgtctttggcgtttatgggggctaaacaggctaggcgtggccgtcgtgatcgtagtggtaggaagcgggtgtctgtggtatgaactcggatgagttggctctgattgagggcatgtacgatcgtatccaaaggttgtcttcgtggcattgccgtattgagggctactatgagggttcgagccgggtgcgtgatttgggggttgctattcctccggagttgcagcgtgtgcaaacggtggtgtcgtggcctggtatagctgtggatgctttggaggagcgtctggattggcttggctggacgaatggtgacggctacggcctggatggtgtgtatgctgcgaatcggcttgctacggcgtcgtgtgatgtgcatttggatgcgctgatttttgggttgtcgtttgtggctgttatcccccaggatgatgggtcggtgttggttcgtccgcagtcaccaaagaattgcacaggcaagttttctgccgatggttctcgtctggatgcgggtttggttgtgcagcagacgtgtgatcctgaggttgttgaggcggrgttgttgctgcctgatgtgattgttcaggtggagcggcgcgggtctcgtgaatgggttgagacgggccgtatcgagaatgtgcttggggcggttccgcttgtgcctattgtgaatcggcgcaggacgtctcgtattgatgggcgttcggagattacgaggtctattagggcttacactgatgaggctgttcgcacactgttggggcagtctgtgaatcgtgatttctatgcgtatcctcagcgttgggtgactggcgtgagcgcggatgagttttcgcagcctggctgggtcctgtcgatggcttctgtgtgggctgtggataaggatgatgatggtgatactccgaatgtggggtcgtttcctgtcaattcgcctacaccgtattcggatcagatgagactgttggcgcagttgacggctggggaggctgctgttccggagcgttattttgggtttatcacgtctaatccgccgtcgggtgaggcgcttgcggcggaggaatctcggcttgtgaagcgtgctgagcggcgtcaaacgtcgtttggtcagggctggctgtcggttggtttcctggctgccagggcgcttgattcgrgtgttgatgaggccgatttttttggtgatgtgggtttgcgttggcgtgatgcttcaaccccgactcgggcggctacggctgatgctgtgacgaagcttgtgggtgtcggtattttgccggcggattctcggacggtgttggagatgttggggcttgatgatgtgcaggttgaggctgtgatgcggcatcgtgccgaatctgcggatccgttggcggcgctggctggggctatatcgcgtcaaactaacgaggtatgataggcgatggcttcgggtgttgcgtcgaggttggctgctaccgggtatcagcgtgaggcggtcaggtttgccgggaagtatgcgggctattatgccgagttgggtcgtttgtggcattccgggaagatgagtgacacacagtatgtgcgtttgtgtgtcgagttggagcgtgccggccatgacggttccgcggctatggcgggcaaattygtttcagattttcggaagcttaacggtgtgggtcctggtttgatcgtgtatgacgagtttgatgctgctgcggctttggcgaggtcgttttcgactatgaagattatgaatagtgacccggatagggcgaatgatactattgatgctatggcggcgggtgttaatcgggctgtcatgaatgctggccgtgacacggttgagtggtctgcgggtgcgcagggtaggtcgtggcgtcgggtgactgatggtgatccgtgtgctttttgtgccatgttggctacgaggtcggattatacgactaaggaaagggcgctcacgactggtcatactcggcgtcataagcgtggcggtaagcgtccgctgggttcgaagtatcatgatcattgtgggtgtacggtggttgaggttgttggtccttgggaaccaaatagggctgataccgagtatcagaaggtttatgagaaggctcgcgagtgggttgatgatcacgggttgcagcagtcgcctggcaatattttgaaggctatgcgtactgttggcggcatgagataatttgatgtggtttccggttgtgtatcgccggttatcggtgcacagggttgtctcccgcacgggggtcaacaatgttgtgttgttttccgcaaggagtgtagggttaggctatggccgatcagagtgttgaggaacagaatgttgacaatgatgttgtggagtccggaaaggataacggcattgttgatacagtaaaagacgatggcgggcaggaggtagccgacaatcagttgaagaatgaaggcgagggtaaatcgccggggactgattggaaggcggaggcccgtaagtgggagtctcgtgcgaaaagtaattttgccgagttggagaagcttcgtacatcgagtgacgattctggatctactattgatgagcttcgccgcaagaatgaggaactcgaagacaggatcaacgggtttgttcttgagggtgtgaagcgcgaggtggcttcagagtatggtttgtccagtgatgcgatcgctttcttgtcgggtggcgataaggagtcgcttgccgagtctgcgaaagctttgaagggtttgatcgaccagagtggtggtggcgcgggtgtgcgccgtcttgcggggagtgcccccgttgatgatgttaaacgacgtgagggtgtcgcgtttgtggatgctcttgtcaataattctaggagatgatttgtgatggctgacgattttctttctgcagggaagcttgagcttcctggttctatgattggtgcggttcgtgaccgtgctatcgattctggtgttttggctaagctgtcgccggagcagccgactattttcggccctgtgaagggtgccgttttcagtggtgttcctcgcgctaagattgttggtgagggcgaggttaagccttcggcttcggtggatgtttcggcgtttactgcccagccgatcaaggttgtgactcagcagcgtgtctcggacgagtttatgtgggctgacgctgattaccgtctgggtgtgcttcaggatcttatttctcccgctctgggtgcctcgattggtcgtgccgtggatcttattgctttccacggtattgatcctgctacgggtaagcctgctgcggctgtcaaggtgtcgctggataagacgaagaatgttgttgatgcaaccgatagcgctacggctgatcttattaaggctgtcggcctgattgcgggtgctggtttgcaggttcctaacggggttgctttggatccggcgttctcgtttgccctgtctactgaggtgtatccgaaggggtctccgcttgccggccagcctatgtatcctgccgccggttttgctggtttggataattggcgcgggctgaatgttggttcttcttcgactgtttcgggtgccccggagatgtcgcctgcctctggtgttaaggctattgttggtgatttctctcgtgttcattgggggttccagcgtaacttcccgatcgagctgatcgagtatggcgatccggatcagactgggcgtgacctgaagggccataatgaggttatggttcgtgccgaggctgtcttgtatgtggctatcgagtcgcttgattcgtttgctgttgtgaaggagaaggctgccccgaagcctaatccgccggccgagaactgatttatcgtagcggtgatgtgtcaatgtgcagggggtggtgttgatgggtatcattttgaagcctgaggatattgagcctttcgccgatattcctagagaaaagcttgaggcgatgatcgccgatgtggaggctgtggctgttagtgtcgccccctgtatcgctaaaccggatttcaaatacaaggatgctgccaaggctattctgcgtcgtgctttgttgcgctggaatgataccggggtttcggggcaggtgcagtatgagtctgcgggtcctttcgcccagactacacggtctaatactcccacgaatttgttgtggccttctgagattgctgcgttgaagaagttgtgcgacgagagtggtggggctggtaaagcgttcactattacaccgaccatgaggagtagtgtgaatcattctgaggtgtgttccacggtgtggggtgagggctgttcgtgcgggtcgaatattaacggctgcgatggccctttgtgggagatatgatatgaccagttttccttatggtgaaacggttgtgatgcttcaaccgactgttcgtgtcgatgatcttggtgacagggttgaggattggggtcatcctgtagaaaccgtgtaccataatgtggccatctattcttctgtgtcacaggaggatgaggcggcaggccgtgactcggattatgagcattggtcgatgctgttcaagcagcctgttgtgggcgctgattatcgttgccggtggcgtattcggggtgttgtgtgggaggctgacgggtctcctatggtatggcatcatccgatgtctggctgggatgctggtacgcaggttaatgtgaagcgtaagaagggctgatagattgtggctcaggatgtgaatgtgaagctgaacttgccgggtattcgtgaggtgttgaagtctcctggggtgcaggctatgttggctgagcgtggcgagcgtgtcaagcgtgccgcttcggcgaatgtgggcggtaacgctttcgataaggcccagtatcgtggcggattgtcgtcggaggttcaggttcaccgtgttgaggctgtggcgaggattggcaccacctataagggtggtaagcgtattgaggcgaagcatggcacgttggctaggtcgattggggctgcgtcgtgatcgtttacggtgatcctcgtgtgtgggctaaacgcgtgctcaaggatgatggctggctgtcggatataccgtgcacgggtactgtgccggatcaatttgagggtgacctgatttggcttgcgttggatggtggtccacagttgcatgttcgtgagcgtgtttttcttcgcgtgaatgtgttttcggatataccggatcgtgctatgtcgttggcgcgtcgtgttgaggctgtgctggttgatggtgtggatggtgatccggtggtgttttgtaggcgttctacgggtcctgatttgttggttgatggtgcacgttttgatgtgtattcgctgtttgagctggtgtgccgtcctgtcgaatccgagtaaacgtatttgttttctatattttgtttttgtttgattatttttgggggttgtgatggctgcaacacgtaaagcgtctaatgttcgctctgctgttacgggtgacgtctatattggtgccgctcacgccggtgacactattgatggtgtgaagacggttcctgacggtcttaccgctttagggtacctgtcggatgacgggtttaagattaagcctgagcgtaaaacggatgatttgaaggcttggcagaatgcggatgttgttcgcactgttgccaccgagtcgtctatcgagatttctttccagctgatcgagtctaagaaagaggtcatcgagctgttttggcagtcgaaggttactgccggatccgattctggttcgttcgatatttctcctggcgccacaacgggtgtgcatgctctgttgatggatattgttgatggcgatcaggttattcgctactatttccctgaggttgagcttatcgatcgtgacgagattaaggggaagaatggcgaggtttacgggtatggtgtgacgttgaaggcgtatcctgcccagattaataagaagggtgatgcggtgtctggtcgggggtggatgacggctttaaaagctgatactcctccggttcctccgaagcctcagccggatccgaatccgccgtccgataactgatacacattataagggattgttgatagatgagtgacacaggttacacgttaaagattggtgaccgtagctgggtgttggctgatgctgaggagacggcgcaggctgttcctgcccgtgtgtttcgccgtgcggctaagattgcccagtcgggggagtctgcggatttcgcccaggttgaggtgatgttttctatgttggaggctgccgccccggctgacgctgtggaggctttggaggggcttcctatggttcgtgtggcggaggttttccgtgagtggatggaatacaagcctgacggtaagggtgcctcgctgggggaatagtttggctccacggcctgattgatgattatcgtggggccatcgaatacgattttcgcactaagtttggtgtttctgtttatagtgttggtggcccggtgatgtgttggggtgaggctgtccggctggctggcgtgttgtgtaccgatacgtctagccagttggcggcccacctgaatggttggcagcgcccgtttgagtggtgtgagtgggctgtgctggacatgttggatcattacaggtctgctaatagtgaggggcagccggagcctgtggcgaggcctacggatgagcgtagggcccggtttacgtctgggcaggtggacgatattttggcgcgtgttcgtgccggtggcggggtgtctcgcgagattaatattatggggtgaatagtgtatgtctggtgagattgcttccgcatatgtgtcgttgtatacgaagatgcccggtttgaaggctgatgttggtaaacagctttctggggtgatgcctgctgagggtcagcgttcgggtagcttgtttgctaagggcatgaagttggctttgggtggcgccgcaatggtgggtgccatcaatgttgctaagaagggcctcaagtctatctatgatgtgactattggtggcggtattgctcgcgctatggctattgatgaggctcaggctaagttgactggtttgggtcacacgtcgtctgacacgtcttcgattatgaattcggctattgaggctgttactggtacgtcgtatgcgttgggtgatgcggcttctactgcggcggcgttgtctgcttcgggtgtgaagtctggcgggcagatgacggatgtgttgaagactgtcgcggatgtgtcttatatttcgggtaagtcgtttcaggatacgggcgctatttttacgtctgttatggctcgcggtaagttgcagggcgatgacatgttgcagcttacgatggcgggtgttcctgtgttgtctttgcttgccaggcagacgggtaaaacgtcggctgaggtgtcgcagatggtgtcgaaggggcagattgattttaacacgtttgcggctgcgatgaagcttggcatgggtggtgctgcgcaggcgtctggtaagacgtttgagggcgctatgaagaatgttaagggtgccctgggttatcttggtgctacggctatggcgccgtttcttaacgggttgcggcagatttttgttgcgttgaatccggtgatcaagtcggtgacggattctgtgaagccgatgtttgctgccgtcgatgctggtattcagcgtatgatgccgtctattttggcgtggattaaccgtatgccgggcatgatcacgagaatgaatgcacagatgcgcgccaaggtggagcagttgaagggcatttttgcgagaatgcatttgcctgtccctaaagtgaatttgggtgccatgtttgcgggtggcacagcggtgtttggtattgttgctgccggtgtggggaagcttgtcgcggggtttgccccgttggcggtgtcgttgaagaatttgttgccgtcgtttggtgctttgaagggtgccgctggcgggcttggcggcgtgtttcgcgccctgggtggccctgtcggtattgtgatcggcttgtttgcggcaatgtttgccactaacgcccagttccgtgccgctgttatgcagcttgtgggggttgttggccaagctctgggccagattatggccgctattcagccactgtttggtttggttgccgggctggtggcacagttggcgcccgtgttcggccagattatcggtttggtggctggtttggcggctcagcttgtgcctgtgattggtatgctggtggcacggctggttcctgtgatcacgcagattattggtgcggtgacacaggttgctgcaatgttgctgcctgcgttgatgccggtgttgcaggctgttgtggctgtgatacggcaggttgttggcgtgatcatgcagttggtgcctgttttgatgcctgtgattcagcagattttgggtgctgtcatgtctgtgctgccacccattattggcctgatccggtcgctgataccggtgatcatgtcgattatgcgtgtggtggttcaggttgtgtcggcggtgttgcaggtggtggcccgtattattccggttgttatgccgatttatgtttcggtgattggattcattgccaagatttatgctgcggttatcgtttttgaggctaaggttattggcgctattcttcgtactattacgtggattgtgaatcattcagtgtctggcgtgaggtctatgggcacggccatccagaatggctggaatcatatcaaatcgtttacgtcggcgtttattaacggtttcaagtcgatcatttctgccggtgttgccgcggttgtggggttttttacgcggcttggtttgtcggttgcctcccatgtgaggtctggttttaacgcggcccgtggcgctgtttcttctgcgatgaatgctatccggrgtgttgtgtcttcggtggcgtctgctgttggcgggtttttcgggtcgatggcgtctagggttcggaatggtgctgtgcgcgggtttaatggtgcccggaatgcggcttcttctgctatgcacgctatgggctcggctgtgtctagtggtgtgcatggtgtgctgggttttttccggaatttgcctggcaatattcggcgtgcgcttggtaatatggggtctctgttggtgtctgctggccgcgatgtggtgtctggtttgggtaatggtatccggaatgctatgagtggcctgttggatacggtgcgtaatatgggttctcaggttgcgaatgcggcgaagtcggtgttgggtattcattccccgtcgagggtgtttcgtgaccaggttggccggcaggttgttgccggtttggctgagggtattactggtaatgctggtttggcgttggatgcgatgtcaggtgtggctggtcggctgcctgatgcggttgatgcccggtttggtgtgcgatcgtctgtgggctcgtttaccccgtatggcaggtatcagcgtatgagcgagaagagtgttgtggtgaatgtgaatgggcctacgtatggggatccgaacgagtttgcgaagcggattgagcggcagcagcgtgacgctttgaacgcgttggcttacgtgtgattgggagtgttgtgcatgtttcttcctgacccgtctgatcgttctggtttgactgtgacatggtttatggatccgctgtttggcgacgagcgtgtgcttcatttgacggattatacgggtgcgtctcctgtcatgttgttgaatgattcgttgcgcggcctgggtgttcccgaggtggagcatttttctcaaactcatgttggggtgcacggttcggagtggcgcgggtttaatgtgaagcctcgcgaggtgacgctgccggtgttggtgtcgggtgttgacccggatccggtgggcgggtttcgtgacggttttttgaaagcctatgacgcgttgtggtctgcttttcctcccggggaggagggcgaactgtcggtgaagactcctgccggtgttgagcgtgtgctaaaatgccggtttgattcggtggatgacacgtttacggttgatccggtgaatcgtggctacgcccgctatgtgattcatttgacagcctatgacccgttttggtatggggatgagcaaaagtttcgtttcagtaacgcgaagttgcaggattggttgggtggcggcccggtcggcaaggatggtacagcgtttcctgtggtgttgacgcctggtgttggttctggctgggataacctgtctaataagggtgatgtgcctgcgtggcctgtgattcgtgttgaggggcctttggagtcgtggtctgtgcagattgatggtttgcgtgtgtcatcagactatccggttgaggagtatgattggattactattgatacggatcctcgcaaacagtctgcattgttgaacgggtttgaggatgtgatggatcgtttgaaggagtgggagtttgcgcctatcccgcctggcggttctcggagtgtgaatattgagatggttggtttgggtgccattgttgtgtcggtgcagtacaggtttttgagggcttggtgaacgattcatggctggttttgtcccgcagataacattgtttacgccagactatcatcgggtggcgcctatcaatttttttgagtcgctaaagttgtcgttgaagtggaatggtttgtcgacgctggagttggtggtgtcgggtgatcattccaggcttgacgggttgacgaggccgggtgcacggctggttgttgattatggtggtggccagattttttctgggcctgtgcgtagggtgcacggtgttggtccttggcgttcttcgcgtgtgactatcacgtgtgaggatgatattcggctgttgtggcgtatgctgatgtggcctgtgaattatcgtcctggtttggttggtatggagtggcgtgccgacagggattatgcccactattctggtgctgcggagtcggtggctaagcaggtgttgggggataatgcttggcgttttccgcccgatttgtttatgaacgatgatgagcgtcgtggacgctatattaaggattttcaggcccggttccacgtgtttgccgataaactgttgccggtgttgtcgtgggctcgtatgactgtcacggtgaaccagtttgagaatgcgaagtttgatcagcggggtttggtgtttgattgtgtgcccgcggtgacccgtagtcatgtgttgactgccgagtctgggtctattgtgtcgtgggagtatgtgagggatgctcctaaggcgacttcggtggttgtgggtggccgcggcgagggcaaggataggctgttttgtgaggatgttgattcgatggccgagggggactggtttgatcgtgtagaggtgtttaaggatgcccgtaacacggattcagagcatgtgcatcttattgatgaggctgagcaggtgttgtccgagttgggggccacgtcggggtttaagatcgagttggctgagtcggatgtgttgcggtttgggcccggcaatctgatgcccggggatttgatctatgtggatgtgggctcggggcctattgcggagattgttcggcagattgatgtggagtgtgattcgcctggtgacgggtggacgaaggtgacaccggttgcgggggattatgaggataatccttcggctttgctggcgcggcgtgttgctggtttggctgctggtgtgcgggatttgcaaaaattctagaaaagattaggggtttgttgtgggtattgtgtgcaagggttttgatggtgtgttgaccgagtatgattgggctcaaatgtctggtctgatgggtaatatgccgtcggtgaaggggcctgacgattttcgtgtcggtactacggttcagggtgccacagtgttgtgtgaggttttgcctgggcaggcttgggctcacggggtgatgtgtacttcgaatagtgtggagacggtgacagggcagcttccgggtcctggtgagacccgctacgactatgtggtgttgtcgcgggattgggagcagaatacagccaagttggagattgttcagggtggtcgtgcggagcgtgcccgtgacgtgttgagggccgagcctggcgtgtaccatcagcagctactggctactttggtggtgtcgtctaacgggttgcagcagcagctggataggcgtgctatagcggctagggttgcgtttggcgagtctccggcttgtgacccgaccccagtagagggtgaccgggtgatggtcccctctggggctgtgtgggctaaccatgctggcgaatggctgcagttgtctccgcgtatcgagacgggcactaagcagatccagtttggcgggtctgccgtgtatgcttacacgatcccgtttgagcggccgtttagtagtgcacctgttgtggtggcgtctatggctacggcggctgggggcacggcacagattgatgtgaaagcctacaatattactacaagtaaatttgatttggcgtttattacgaatgatggttcgaagccttctggtgtgcccgcggttgcgaattggatagctgtgggcgtgtgattatacaggtgttgtggtggctggtgtgatgttggggggctgtggtgtcgtggtttactcctgcactggtggcctctatttgtaccgcgttggccacggttttgggttctgttcaggctgtcacgtctaaatcgaggaagcgtttgcgtcggctgtcggcccaggtggatgctttggaagagtatatgtggggtgtgcggcatgaggttcgccggtttaacgccgggcttcctgacgaggtggagcctatgcatcttcctgatttgcctgagtttttgaaagatactgttgatggtggaggtgagcagggttgagggagttggaggaggagaagcggcagcgccgcaattttgagaaggcttcactgttgttgctgtttttgtcgcttgtactactagcggtggttgctgcgggtgctttgcgtttcggggctgtatcctctgagcgggattcggagcaggcgagggcccagtcgaatggtacggctgccaggggtttagccagccgtgtgaagcgggtgtgtgcttcgggcggggtggagtctgcgcggcttcaccgttctggtttgtgtgtggatgctgtgcgcacggagcggagtgtgcagggtgtgcctggcccagccggtgagcgcggcccgcaaggcccggctggtgtggacggccgggatggtgttaatggttcggccgggctggttggccctgttggtccgcagggttctcctggcttgaatggtgtgaaaggtcctgacgggttgcccggtgctagcggcaaggatggtgccgctggtgttgcgggccgtgcaggtgctgatggtgtgaacggcgttgatggtcgggatggttcggccggtgagcgcggcgatgtgggtccttcaggtcctgccggcccccaaggtgtacagggtgagcgcggtgccgctggtgtgaacgggtccgatggtaaagacggtaaggatggccgttctgtggtgtccgtgtactgttccggggggcgcctgtttgtgaaatatagtgacggtgtggcttctacaatatcgggctcggtggcatgccagggtgtggccccgtcacctgtggttaccgtatcatcccgcaaatgaatgatagtggaagggtgttactcatgttgatagtagtgtttgggggtggtgtgtggtgagatacattccagcggcgcatcactcggccggctcgaatagtccggtgaatagggttgtgattcacgcgacatgcccggatgtggggtttccgtccgcctcgcgtaaagggcgggcggtgtccacggcaaactattttgcttccccatcgtctggtggttcggcgcattatgtgtgcgatattggggagacggtgcagtgcctgtccgagagcactatcgggtggcatgccccgccgaatccgcattctttgggtatagagatttgcgcggatggcggctcgcacgcctcgttccgtgtaccagggcatgcttacactcgggagcagtggcttgatcctcgcgtgtggcctgcagttgagagggctgcggtgctgtgccggcagttgtgtaacaagcatggtgttccgaaaaggaaactgtctgtggctgatttgaaggctggccggcggggtgtttgcgggcacgtggatgttacggatgcgtggcatcagtcggatcatgacgatcctgggccgtggtttccgtgggacaggtttatggccgtagtctgcggcggtagtggtagkgaggagttaactgtggctgatgtgaaagctttacatgatcagattaaacaattgtctgcccagcttactggttcggtgaataagctgcaccatgatgttggtgtggtgcaggtgcagaatggtgatttgggtaaacgtgtggatgccctgtcgtgggtgaagaatccggtgacggggaagctgtggcgcactaaggatgctttgtggagtgtctggtattacgtgctggagtgtcgtagccgtattgacaggctcgagtctgctgtcaacgatttaaagaagtgatgtgttgtgggtaaacagttttggttgggtttgtttgagcgtgccctgaaaacttttattcaaacgtttgttgctgtgcttggggttactgcgggtgtcacgtatactgcggagtcgtttcgggggcttccgtgggagtctgccctgattacggccggggtggctgctgtcctgtcggttgccacctcgtttggtaacccgtcgtttgtggccggcaatccgaagacgcctatggatgctgggcttgttccaccggatgacgggggcttggttgagccgcactcggtggatgtgtcggatcctggcatgattgagccgatggatgatgcggatgttgccggctatgtgccgaagcgtgccgccgagtctgaggttggcacggtagagtctactgttgcataattgaatatgtgtgtgtgccccagcggtgctgccacgacgtgtggtggttgctgctggggcactatttttgtgtctacaggggttttacaggttgtcgtctagggtgtcttcgagtgtctgttgtaggagtgcacactcggcgagggtgtcttcagcctggtcgacaatgttttgttttgctatgcctggatagttgtcgcggtgattgtagatggcttccagaatgttgtctgccatgatttgtagtgttagggcctggttggtgatgcattccagctcgtctagggcggcctggctagcctccggttgccggttgtccggatgttctgcaaggttgcagtcccacaggatttcttggcatgcatccctggtgtctgcgtccacatcgatgtcgtctaggctgacaccgttggcgttgaggctgatgttgtcgaggttgatgtggacgcagatattcgctgctgatgctgcaggtgatgtttgcgagttctgtcatgtttcgtggctgctgctgtataatgcggcgggccgcggttttgagggctgtgactgttcggtgtctgttactgggcatcgtttctattcttcttccccggtgtagctggtggtgttggtgtactgggtgagtgtgatcaggcactggtcggcccactgtttcaccgtctgccgtgtcacactcaatcgttgggctgccaccgaataggtttgatcatacccgtagacttccctgaatgcggcaagccgtgctagccgtttccgctgtttggatggttcacatgtgagggtgtagtcgtcgatggccagttgtagatcgatcatggctacaatgttgttgccgtggtgttgtggcgcggttggkgggggtggcatgcccggttcgacactcggtttccatgggccgccgttccagatccattgggcggcttggatgatgtcggctgtggtgtaggtttggttcactggtcatccccggaataggttgtcgaggttgtctgggttgctggtgttggtggtgtcgaatcgtcccacacagtggcagtagtcgtacatgagtttgatgatgtgttggtggtcgccgaggtaggtgtttccgctgatgctgtaggtggctgtgccgtcttttgcgatggtgtatttggcggtgattgtttcgggtgtttcggtgttggtgatgattgctgtggtggtggtgcctacggtttgtagcctggtggtttgggttccgtcgtcgaggatggtagtaaccatgagggttgtcctttagatgctggtttggttgtcggctagatgaataatatcggataaaggtttcggctggtctaggtgttgtatggttttgttggctagccgtttggctaccctgtaacacattttggtatagtgtttgttgtctaggttgtggtattgttcccgcaccgcaatatatagtagggagtcttggtacaggtcgtctgcactgattgctgggtagtgtccggctgttttggtgcatgcccggttgagtgtgcggagatgatggtttgtggcccacacccacgatgcggtggtggccaggtctgcttttgttggtcgtctgctcatggcactatttcatctcgctatctggtagttgtttggtgttttgttgttgatagtgtagcacacgagtccggggttgccggtggtgcctgtgcggtgccggtaccagacggattctccttccatggatgggcattggatgaaggtgcgttgtccttgctcagagatttctaggtggtgccggtgccctgccatgaggatgtgagatgtggtgccgttgtggaattcttggccgcgccaccattcgtagtgttggttgttgcgccattggtgtccgtgggcgtgcaggatttgtgtgcctgccacatcgacggtggtggtcatttcgtcccggctggggaagtggaagtgaaggttgggatactggttggtgatctggtaggcttctgcgatggcgcggcagcagtccacgtcgaaggagtcatcgtaggtggtgactcctttgccgaagcgtactgcttcaccgtggttgccggggatggaggttacggtgacgttggcgcagtggtcgaacatgtggacgagttgcatcatggccatgcgggtgagcctgatttgttccgtcaagggtgtttgtgtgcgccaggcgttgttgcctccttgtgacacgtatccttcgatcatgtcgccgaggaaggcgatgtggactcgttcggggttgccggcttgctgccagtagtgttttgcagcggtgagggagcgcaaatagtcgtcggcgaatcggctggtttctccgccggggatgcctttgcctatttggaagtcgcctgccccgatgacgaatgcggttttactgtctgttgtggtgttgtctgttgtgggtggctgccagtcggctagcttagctacgagttcatctacaggatatgggtctgttgcgggttggtggtcgatgattttttgtacggatcggcctgtttccccgttcggtaaggtccattcggagatgcgtgtacggcgcacggttccgttggctagatcatcattaatggtgtcgatggcgttgtcgtggttggctagctgtgtgaggagccggtcaatattgtctatcactggttttcctcctccttctgggggttggtttgtttgcggcgataatctttaataacggtggctgagatggggtatccggcttgggtgagctgttttgctagccatgaggcggggatggttttgtcggcgagcacgtctgcggctttgttgccgtagtgttgaataagggtttcagttttggttgccatgatgtcctaggggttgtgtggtgggctgccatcctgtgcggcagtcgccgtcgtgtcctggtttgcgtgtgcaccacgtgatggttccgtctgtgtggtggagtgttttgccgcacatgacgttttgtagatgctccggcagtgcgccgtcatcctggttgctggtttgtgtgtcgaagagtgttttctggttggtgaaatgctctgacacggtgccgttatgcacgggtagtatccatgttttccattgttgttgtagccgtgtgttccagtggaattgtttggcggcgttttctgcctgttttatggttttgtagtagccgactagtatgcgctggtgttcactgtcgggtgggttttggcctcgccagtattgtgctgctacggcgtaacggttgttttctgtgaaggtgttccagcagtattcgataatgttgttgagtgtgtcgtctgtaacatctgtgtcgctgtttagtgtttcttgggcgatgatgtcgcggatggcttgccgattttttgtggtgggtttgaaggtgatgctcacgatagtaccggctcgtcttgcaggaactggttgaaggtgttgttcccggcgtgttgggcttgtgtgatgtcctggtcggtccagtcggggtgttgctgtttcagatagtaccagcggcacgcattgtaggtttcgtcttgtagccgtgtgagatggttttcggtgatgatttgtttccacattgtccatgacacgtcgagccggtccaatatttccattgctgggatgttgaattggtcgaggaagagtatttcgtgggtgtagtattccttctcgtactggtcccatccgcttcggtgcctgttgggctggtttttggggtaggcttcccggcatactttgtgcaaacgtttggccatgtcgtcgggtagtttaatgtcagggttggcgcggatcatggatcgcatcccatcataggtggtgccccaggtgtgcatgatgcggagtgggtcttcaccgtcggcccatttttctgcacagatggcgaggcgtatacgcctcctggctgtttggctggtgttgcgccggttggggatggggcacgtgtcgaggggatccatgatgttttagtgtacctttctggtttcgtgttgttgacgtgttttactgtagcacagtgtttagtgcttgtgtcaaccctgtttttccggcctgcaggtaggtgtctgtgacatcccccagggtgaggggcacgtggatggcttgggggagtgcggtttggagggtttgggccatctggtctcccgctttgtctgggtctgaccagatgtagatgtggtcgtagccttcgaagaatttggtccaaaagttttgccacgaggttgcgccgggtagggctacggctggccatccgcattgttcgaggatcatggagtcgaattcgccttcgcaaatgtgcatttcggctgccgggttggccatggcggccatgttgtagatggagcctgtgtctcctgccggggttaggtatttggggtggttgtgggttttgcagtcgtgcgggagtgagcagcggaaacgcatttttcgtatttcggctggccgcccccaaacggggtacatgtaggggatggtgatgcactgattgtagtcttcgtggctggggatggggtcattgtcgatgtatccaaggtggtggtagcgggctgtttcttcgctgatgcctcttgctgagagcaggtcgagtatgttttcgaggtgggtttcgtagagggccgaggctttctggattcggcggcgttccgcaatgttgtatgggcgtatgctgtcgtacattcgggttttcttcttctaatcgttgttgtagtttggcgaggcctcctccaacaccgcatgtgtggcagtaccagactccttttgtgaggttgatgctcatggagggctggtggtcgtcgtgaaacgggcagagtatgtgttgctcgttcctggatggattgtaccgtatgcggtaggtgtcgaggaggcggcaggtgtcagaggtgtgggaggagctcgttgagggttgataccacataggcttcactccatggcttgttgcgctgtttcatcacgacgagtccgatagtggactggctggttttgtttcggtgtgtttcgtagttgcgcgcctcggttgtggcttctttcacgaattgagccaaatgctgctggccagccttggcttcgatcacatatgttttgttgccggttgtgaggatgaggtcgccttcatcttcgcggccgttgaggtggaggcgttcgatattgtggccggtgttgcgtagctggtggaggagtcgtgtttcccattcggcccctgcccgccggttgcgtgcctgctgtgttggcattgtttagagtcctttgtgtgttgtggtcatgttccagggctgtttttcgacgaggggcccaaaaaaggtgtattcggggtaggctcgtagccgctcgtatcgggtgccgtcggggctggatttgcctgtgcgctgtttgagtacggcgatgcgtgcctctgccggtatcgatagcccgttgccgttatcctcaccaccatacaatgagactccgaggatgagttgtggtttttcggagaggccgtttttgatttccctccggtggggcgggtgttcgatgtcggatccggttttgtcggtggcgtggtgggkgacaataatggtggagccggtatccctacctaatgctgtgatccattgcatggcttcttgttgtgcctggtagtcactctcgcagtcttggatgtccatcaggttgtcgataacaatgatggggggaaagtggttccacatttccatgtaggcttgtaactccatggtgatgtcggtccatgtgatgggtgactggaatgagaatgtgatgtgttggccgtggtggatgctgtctcgatagtattctggcccgtagtcgtcgatgttttgttgtatctgggcggtggtgtgttgggtgttgagtgagatgattcgtgtggaggcctcccagggtgtcatgtcccctgatatgtagagggcgggctggttgagcatcgctgtgatgaacatggctagcccggatttttggctgccggagcgccccgcaatcatcaccaaatcccctttgtggatgtgcatgtccaggttgcggtagaggggttctagctggggtatgcggggcagttcggcggctgtttgggaggctctctcgaaggatcgttgtagagagagcatcgggaccttaatctatctatcggttggatgtgtattggtggtcagatggagtcaatgtctacatcatcgctgccagtggtgttgggctggctgtctcgcttgtcaacgtaggctgctacgaggtcgtagatggcgtcgtcgaggggtttgaggatgacagcgttgaatccgtttttggtgcgcacggtggcgagtttgaaggcctgctcctcgccaaggtaggtttcgagttcgcggatcatggagtgtgggcggtcgttgttgcctcgcgctttttcgatgatggcgttggtgrtggtttctggggtgccgttgttgaggtcgtctagggtgtggaagatggtgacatcggcgtagatgcggtcggcgacctgtccgccgtagccttcagtgttgtgttcgacgtcgtgtactttgaagacgatggcggtggcgtcctggtttttggacgggttgaagaaggtgctgctgttgctgttgttgcggtagttggcgagtcccataacggtatcctttgcttgctttttgtgttgttttgttggtttgtgtcggtttttatcgggtgrggttgttccgtttagtgcggaaagcctcggatacgtcactgttactggtgatgatctttttgtactgtttgagtagatcggctagctgtgccttgcttgttgctttgttgattttgttgatgatgatgtcgttttcttgattggcaatattgtttacgtagtttttggcggcctggttgtatcggtcttggaggatgatggatgcgcttgctaccaaggtggctaaatcccagtctttggatacggtgttgtctttgagcccgccgaggaggtcgatgatagtcttcttcacctggtcggcggtgtcgccgcggatgacggtccatggtgctgcgtagtctccaccgtatttgagtgtgatcgttaggcgatcattgtctgtgatatgctcgtcgatcatttggtgtccttttctttatggtctgtttctggtggctgtacggtggtttctatcgggtatctgtacgagtttttgccgttgacggcccagcaggcgtcttgtacggggcatcctttgcagagtgttgtgacgtgtggtacgaagattccttggctgattcctttcattgcttgactgtacatggatgatacatgccggtaggtgttgttgtcaaggtcgtagagttcggttgccgtgccttgtgtcggggatttgttgtcgttgcgactggtggccggcgtccaaaacatgccttttgtcacatcgttgccgtgttggttgagcatgtaccggtatgtgtgcagctgcatactgtctgctggtaggcgtcctgttttgaggtcgaggatgaatgtttcgccggtgtctgtgttggtgaagactcggtcaatatatccgactatttttgtgtcatcgtcgaggatggtttctaccgggtattcgatgcccggcttgccatcaataacagcgatagcatattcggggtgactgtttcgccagtgtttccacctgtccacaaagacttggccgtagagcatccaccagtcgtagtcttttttgttagggcccccactttcgcacatgtttttgcatactctgccggagggtttgatttctgtgccttcggattcggcgagggcgacttgggtgtcgaaaatgtttttgaaggatgagagtttgtctggtagtgcagggtattcggtggggttgtacaggtggaggtcgtactgttcggtgatgtggtgtatggcgcttccggcgatggtggcataccaggtgtggtgctgtgcatggtagccgtgttggaggcgccatttttctccgcattcggcccactgcgacagtgagctgtaggagatgtggcctggatggttgatggttttcggatattgtgctagaggcattacttgtcgcttttgttccatgggttgcgggtgtcttggccggcgtggtgttgctggtaggcgaggagtgcgaggcagtgccaggctgcgtgtgccagatgcggcaaatgtgattcgtggtcgaggttgttgccttgctgccatgatagtagatgcctgtagagggcgtcgacactgtggctccacgggtatcctccggtccagttgttgtcgccgtatttggkggcgccgtatcctgccacagagcctagatcgtgcaaggctgcggggtcgatgagggagagcctgcagagtttgagttcttttcgggcacctgtgttggggtcggtgtacatgcgggtgggctcatccatggggtgtgtgctccttaagggtgggttactggttgttgttttgggctagggctacggcgagaataatgatggcgagggtttcagcaatgatgatgggtgttgtgatcatttagtattacggggattgttggtgagggttgaggcacctagtagggtggcgagggcgcatgcggcgatgatggcgagggcggctttgtggctggtgcctgttgcgtacatccatgtgatgatgccgccttggatccaggcgaggctggtgaagaacgtttcgtagctgtggaggttggcgtcggttggtgtgttcattcttgttcctcgatggtgtggttgattgttttgtagatgtcgtatagttgtgcttcgatttccagtagtgtgtttatttcgtttgtgaggtcgatttctgttttgagtgtgtctattctggaagcgatgtcagtggctgtttggagtgagagttcggcgccgtggatgatgtggccgatatcggagaggccgactttggctgtgtagtctgacatgagagacattggacgtccttagcgtgctgggttgatggacaggtcatctacctgtgggttgtcttctgtgccggagacttggcagaagactttcacctgcgtcttggaagcgccaggttggcgtgccgtagccccgtaggcgatcgagaaggtgtcttttttgctgccgatcactttgtggaggaagaggtcgatgtccgggttgccgttccatttgacgccgttttctgcggcaatctgggtggctttggcgtcgcaggcgtgtgctgccgtaattatggtgagtccggttgcggtttcttcaccccttgattgggcttgcttgtgggttttggcctgctcggcttgtagggagcggactgctgcggcctgcttggctgctttttcggctttgcgctgttgggtagtcttgggggtccatgtggtgttggctgtggtggcttgtggggcgggttgtgaggtgagtggcggattgtcgtcaggtgcagggaggaaagagcatgcggcaataatggcgatagtggcgcctgcgatggtgtagccgtttttcttgttcatgttttgtgtcccctttccggggtgttgttcgttgctgacatgatcaataatggtgtgggcggtggcctgtgtcaaggctgcgctcaacgactgtgagcgtttggtgtgtggcttggggttttatcgggcgcatagggtgagtaggtggccgatgttgatgcgggtcacgttccagtagagttgcgkggcttcaccgccagtgagcggcttccactcatcatggctgaacacggtgccgtcggtggctatgaatgtgttggggcgtagcttgtggagttcggcttcaacatgctgccggtagacttcggcgaggccctcaaaatccaggtggtcgcaggagaggttttcgaggcgtgtcaagtcgaaaggctcagggcagtcgtagctggctgggctgtagagctgggtgaagtggtcggcaatcttctgcatgacgggttccttttctagtgtgtggatggtttttatcgggtggatgcgacaaggatggcgtctacgtcgatcatgtcgatgagatcgtggagttcctcggcctcattctcagataggtggcgccagtcgtagtcgccgtacacggcgccgtctagggtgacagtccacagtggccggatgagccgtatggcttcttgtactttagcgtggtacatgcggcgcaccatatccagatcgatgtcgtctgaatggtttccggtgagactgtcgaggctgagggggtcgatttctgtctgcctgtagagactggtgaaggatggtgtgatgagtgtgccatccatgggggtgctcctttctggattgtttgggttggttgttgtggtttctagggtgtgcaggttgtgacccacagtcaaggctgcgctcattcggattgagtgtttcatgctggagtgtcgggtgtgacagatatcactgaagcctttattgcctctctcagcgtctcaaatcttctgggggtaggattatgcagggttgaccctgttagtcgattctagaggccttctagggcgtctcaggggtatgtctgggggatagcaggtccggtagatgacccagcagatctaccttggctttcatcacgggagtcgaggtgccatatttgggcatgggatctccaccctcatactatgtgagatgtaccacatcctcctggcttgatgtgcactctcgaggccactctaccgatctggcgtggagggtgtagcccagaaatgccgtttaaagccttcacacggcgcctaggagcgtcttgcagggtgggggctaggtatttatacccccagcacattctggtcgattctagacgcctacaggagacagatacgcgatcaaccctctcggcatagatcatcagcccctaccctgcttagctaagcctgcactatgtggacagtgttggatgctgtgggggaagaagggcacggtaaaagaaagaaggggggagtatcagccttcacgcctgaggtacttaagttaaccttaaggtcttagcacttagcaccgagcccctcaagggctcggcatcagcccgaacaggctcagctgatccggcatagccttagcaagtacacgccatcagggaaggcttgagagtacgaggagcctcagcgacgagtactcgaaagcctgagggaagaccatcagcacatcaacgcttagcgtgttcggaaaggacacaggagtacagtgtgagagctgttcgggagtgaaacccgttctggctaggggtttcagccttaaccacctgtaaaggttacaagactctaagaaaatttaaggaaaagtttaggtttgatttttggacctttactaccaaaaacacccgtttacacccctcaaacccgcctatagagccaaacgccggtgttgagggtatctctacctagtgtgataggctggacaggtagccagctggacgcaaggccagaaagtgctaacgcacttcccgacctcgcttaccatcagtctaccaaagacttaaaagcttaacagctaagcgctaagcccttaagacctcaacgcttagcaccgagcccctcaagggctcggcatcagtcctaaggcttaaacacttaaagtaactataaagctttaaaagcttaacacttaataatttaagtaaatataaaaccttaacagttaaacgtttaaagctttaaaacttaacactacagtaagagttaaaagcttataaaccttaacacctaagttaactataaaaccttaaagactaagcacttaaggatataaacttaacatcagtgtttaagactttaaaacttaaagtaactataaaacattaaagctttaaatacttaaagttaaccatcagtcttaaactttaatattataacctataagctttaagacttataggtattataatatattataattatataagttataaaagttttagaagagtaaaggggttaacttctttacttctctactctctttggttctttctctcttctcttcttttcttcatcaggggagaagaggaaccttttaccgtcagcgctgatggtctttcgccgtgtgtctcgtgtgcttggtcgcaagctcccgtcgcacactctccacactcttacacccgtgtccttcttaggcttggcgtgttcggctgaaggcgtacggcgtgtcacgctaacacccttaacataaggtaagacttaaagtgtatattatatgtagaagactttaaaaaccttaagggtgtacacgttttggctgtgccctacaccgctaggcgtcaagcgctaagccttaaaacgcgaacacacacccaccccccttttttctttcgtgtccttctcttttgacaccgctggggggcgatgtgacatttctcacacccgtgggggtagtggagaaaacaaacaccccaccacagacagaacaccccctcaaacgcacaaaacagcccctagaatcgattagcagggcaagggcaaggtattcatacccccaacggtttccaggccgttacagaggcaaacaagacccgtacaaggctaggcgaggatcggagacgtgatggcacacaccaaccgcaccgcatcctcagcccaccgccgctggcggcaacgactcatcacccaagcccgacagcaaggccaaaccgaatgcccactctgcggagtcaccatcacctgggacacctaccagctaccaaccagccccgaagccgaccacatcacaccagtcagccgcgggggactcaacaccctcgacaacggccaaatcatctgtagaacatgcaacagaagcaaaggcaacagaacacaaccaaacattcaattccaacaacaaaccacaaaaacattgattccgtggtgataaaacccgccaacccccaccgggaccatcccctgcacacccgtgcaa

SEQ ID NO: 51 - DNA, 2299 bp, Propionibacterium acnes
ttggtcagcgcccaccgatgccttacaccgtgacacgctcgaagtggcgatggaacacctacgcttcgaacctgattcgatcgcttcggtggcctcctgctgacgctttcatggatcgtgtcagcctggaggatggtaatgcgcccaaaactgtatgtcttcggtagatctgcacaagcggatcatctcgcgcaagaaggaaccgtgaggtactcgatccggtacactctccacatcaaaaccaacaatacaagtcacagtcatagatagttgtgtcattaacaagaaatcccaacagcaccccaatgcaaaattgcacagaacgacctagccagatgattttcagcaagtctaccatgacagcaaaggccgcagatagaaactgtgacatatacattgcacgctgaacttactaccccaccactaaatttacatagattccataccgacccgaacgccaccagtcaaccatcagtaatcatcatcgagaagtcaaaaataaccaacaccattgataagatccatgccatggacgggcagacgtctgtgatcagcagagtcgagaaacgaggtaaagcaaactatcacgagccaccagataatacccctagaagcttgtccaatatgttagctctggttaacatgccatcgccagcacaagattaacacgcttgttcatgtcttcagaaagcaacgaagctcgcctagatacttggacatttatatccttgcaaacccccccctaaagcctccaaaaatccttgatttacctcactaatataccattaatttgccccacctcaagccaacaaaagaacggagcatcagagccataggaagcctccgccagacataggggactaaacattatctccttctacgtcaccaactagaattcataaagcatcaacctacttatttaattcgatctaaaatccaatatccttagtatcagggatcaataaaaccaaaattaggaaacatacttaaaatcatgacatttcacttagtagacatactttgggattgtatcgacgcgtgacattgacacccatatttctgcggcagaatgcaccccggcaatccattgccaacatgcatgacacaccagcccatcagacccgaggtgaggtgatacactgttggagttagttcctggtacgcaaaccgcacagcccggtaggaagtccgggcggcgcaatagacgtccgtcgctcccctcatggagaatccagtgtcgccaggtccgcttcggcgtactgggagatgatatgcctacgatgttcactgtctacttcgatggccagttctgggtcggagtcctagagaggcgcgacgagggtttggtgcgtgccgtaaaagtcacgtttggcgccgaaccgtctgacacggaattgtacgagtgggttagccgtcatggcaacgcacttatagagcgattggagtctaccgctgctgtccctaccacccgcagtccccgagccaagcgactgaaccccaagagggcgttacgagatgcagcgcgagctgcccaagcaccccgtgccagcacggccgcacaggccgcgcttaaggccgatcaggaagctcggggtcgcgccgccacagtgaagcgcaagcaggcccggatcgacaaagctgcggagcagtgggctaagaaacgagagcgcgcgaaggcaaagcaccgtggccactaatgcgtcgaccgtgcccttcccaactgtgattcttggttcgggacctatggcttcacggtcaaggcggtcaaatcgctcacacatgagtactattcacccgacatgccatcgtctgggcaatcacccaactgcaagctgatgacgttttcctcctaggcttgatgcactagtttagtgtggacaggaagactcatggcgaagggaacggcctgttctcaagatcgccaccgcgaacgagattcacttcccacggtgtacgcatactaaggggcggagcttgtctgacatcatctgggccagcacgcacatggcccagatgatgcccaccggatggtgagcctgacccgtaacaagaacgcatcagcgagcacctcgccgacgcggctgcgcacgcggtcgtaacctcgccactgcctgcgtgaacaacgcgcttcggcgcattcaacacgccgtgaccgcggcgcccacggcttgcgcaaccgctacaactaccacctactgtcgcctcctggtcgttggcggcataacccataaccatcttcaaatccgaagcgccgagtcctgccataattcgaaccttcagcctgcatgactggaacaag

SEQ ID NO: 52 - DNA, 2299 bp, Propionibacterium acnes; identical to SEQ ID NO: 51

SEQ ID NO: 53 - DNA, 2299 bp, Propionibacterium acnes; identical to SEQ ID NO: 51

SEQ ID NO: 54 - DNA, 2298 bp, Propionibacterium acnes
ttggtcagcgcccaccgatgccttacaccgtgacacgctcgaagtggcgatggaacacctacgcttcgaacctgattcgatcgcttcggtggcctcctgctgacgctttcatggatcgtgtcagcctggaggatggtaatgcgcccaaaactgtatgtcttcggtagatctgcacaagcggatcatctcgcgcaagaaggaaccgtgaggtactcgatccggtacactctccacatcaaaaccaacaatacaagtcacagtcatagatagttgtgtcattaacaagaaatcccaacagcaccccaatgcaaaattgcacagaacgacctagccagatgattttcagcaagtctaccatgacagcaaaggccgcagatagaaactgtgacatatacattgcacgctgaacttactaccccaccactaaatttacatagattccataccgacccgaacgccaccagtcaaccatcagtaatcatcatcgagaagtcaaaaataaccaacaccattgataagatccatgccatggacgggcagacgtctgtgatcagcagagtcgagaaacgaggtaaagcaaactatcacgagccaccagataatacccctagaagcttgtccaatatgttagctctggttaacatgccatcgccagcacaagattaacacgcttgttcatgtcttcagaaagcaacgaagctcgcctagatacttggacatttatatccttgcaaaccccccctaaagcctccaaaaatccttgatttacctcactaatataccattaatttgccccacctcaagccaacaaaagaacggagcatcagagccataggaagcctccgccagacataggggactaaacattatctccttctacgtcaccaactagaattcataaagcatcaacctacttatttaattcgatctaaaatccaatatccttagtatcagggatcaataaaaccaaaattaggaaacatacttaaaatcatgacatttcacttagtagacatactttgggattgtatcgacgcgtgacattgacacccatatttctgcggcagaatgcaccccggcaatccattgccaacatgcatgacacaccagcccatcagacccgaggtgaggtgatacactgttggagttagttcctggtacgcaaaccgcacagcccggtaggaagtccgggcggcgcaatagacgtccgtcgctcccctcatggagaatccagtgtcgccaggtccgcttcggcgtactgggagatgatatgcctacgatgttcactgtctacttcgatggccagttctgggtcggagtcctagagaggcgcgacgagggtttggtgcgtgccgtaaaagtcacgtttggcgccgaaccgtctgacacggaattgtacgagtgggttagccgtcatggcaacgcacttatagagcgattggagtctaccgctgctgtccctaccacccgcagtccccgagccaagcgactgaaccccaagagggcgttacgagatgcagcgcgagctgcccaagcaccccgtgccagcacggccgcacaggccgcgcttaaggccgatcaggaagctcggggtcgcgccgccacagtgaagcgcaagcaggcccggatcgacaaagctgcggagcagtgggctaagaaacgagagcgcgcgaaggcaaagcaccgtggccactaatgcgtcgaccgtgcccttcccaactgtgattcttggttcgggacctatggcttcacggtcaaggcggtcaaatcgctcacacatgagtactattcacccgacatgccatcgtctgggcaatcacccaactgcaagctgatgacgttttcctcctaggcttgatgcactagtttagtgtggacaggaagactcatggcgaagggaacggcctgttctcaagatcgccaccgcgaacgagattcacttcccacggtgtacgcatactaaggggcggagcttgtctgacatcatctgggccagcacgcacatggcccagatgatgcccaccggatggtgagcctgacccgtaacaagaacgcatcagcgagcacctcgccgacgcggctgcgcacgcggtcgtaacctcgccactgcctgcgtgaacaacgcgcttcggcgcattcaacacgccgtgaccgcggcgcccacggcttgcgcaaccgctacaactaccacctactgtcgcctcctggtcgttggcggcataacccataaccatcttcaaatccgaagcgccgagtcctgccataattcgaaccttcagcctgcatgactggaacaag

SEQ ID NO: 55 - DNA, 26003 bp, Propionibacterium acnes
cccgctcactgccaacgagacatcacgcagcagcggccgaccatcggccagcgtgtacgtcaccgacgcgacatcgagacgaaccatgacccaaaagtatcacacgtgtgataaatggaggttgagtatggcggcctgttcacttgatcaggcatttcttttagtgaggcctggggcgtaaccacttgtctgcaccttagagctgccacgcctcttgcagatcgaggcagaggaggctgcgcgggggtcgtggcgtgcggtggcggggtttgatgtcacgttcagtgtgccgaagtcggcatcggtgttgtgggcggttgcggacgcggggacgcaggcgttgattgcgcaggcccatcatgagacggttgtggcggtggttgcattcatggagtgcgaggttgcagccatccgcacgggtgcaactgctggggatggcgcggttgcacaggtcgacgtgacgggtttgatcacttcgattcccgcgccggggacccgcacttgcatacgcatgtggtgatcagcaacaaggcccgcacggtcctggatgggaagtggcggagtttggatgggcgttcgatgcatgccgcggtcttggcgctgtcggagctgcacgaggccgtgttcgccgatcacatgacccgcacgttcggtgtgacgtaggagccgcgggagatgggccaggaccggaacccgtcgtgggcgatcaccgacgtccccgaacagctggtggcagagttctcgacccgcgcccggcacatcaacgaggcgaccgacgcgctggttgctgactacgtggcccagcacgggaagcgcccttcgccggcgaccatcatgaaactgcgcgcccaggccacgctcgcgacccgtccggagaagcaggtccgctcacttgcggagctaacagccgagtggcgcactcgtgtcagccagcagctcggtgtggatgccaccgtgtgggcgcggaccgtcacgggtggggagcggcagttgctgttgcgggctggtgatgtgccgttggatctgatcgaggggtggggcggtctgtagtcgagatggtcggtgagaagcgttcgacgtggcggtgctggaacctgatggccgaagtcgcctgccagactgtggggtggcgtttcgccaccgttgaggaccgcgaagtcatcaccgcgatggttgccgacgcagcggaacaggcgtccttacgcctgaccccacccgagctagcgaccagcccggcgaagttccgccgcccggacggcactagcgtatttcgtccgaagcactccacggtgttctcctccgacagcctcctggccgcagaggaccacctcctgcaacgggcccgcaccgcgaccggtccgactatcgacctgaccaccgtggggaccatcacgagcaaggcggacagcgagggtcgggtgctcggtcccgatcaggccgcagctttggcgtcggtcgcggtcccgggccgggtggtggatgtgttggtggggccggcgggggctgggaagactgcagcgatgaacgcaccgcgccgggcgtgggagacggagcatggtgccgggtcggtggtggggttggctccgtcggcggtggcggcccaggtgctggccgatgatctgaggattgccacggagaacacggcgaagtggtggaccacccaccaacacaccggcgtcactttcaaggctggtcagctggtcatcatcgacgaagcttccctcgctgagaccctctctttgaatcggatcacgctggctgctgaggaggcggggacgaaggtgctgctggttggcgactatgcccagctcccgtccgtcgatgccggtggtgcgttcagcctgttgatccacgaccgccacgatgcccccgagctggtcgatgtccaccgcttcacccacgcctgggagaagaccgcatccctggagctgcggcacggccgcaccccggtcatcgacacctacctggcacaggatcgcatccacgacggagacgccgaggccgtgaccgctgccgcttacaccgcctggcgccacgaccggcagcaggggttggcgtcagtactgatcgccgaaacccgcgagaacgtcaccgccctcaacatccacacccgcgctgacctcatcctggacagcacgttgaagcctggccccgaaatcaccctgtccgacgggtccatggcaggcgtgggtgacacgatcatcacccgccgtaacgaccggcggctgcggaaccggcacggctgggtccacaacggccaaacctggaccatcactgccgtgcgtgacgatgggtcggtcacgatccgcccacccagtgcccggttcggcaacagcatcgtcctacccgccgactacgtggctgagcacgtcgacctcggctacgccgtcaccgctcaccgcgcccaaagcatcacaccgacaccgcccacgtcctcgtcgaacccacggcgacgcgggaaacctgtatgtggctatgacgcgcgggcgcgaatcgaaccgggcctacgtcatcctcgaccgtgccgacgaccacgccgccggcgccgtgtgccgtgtgaactcggtcgacagccccggacgctgggtcgcgcggtccgtgatgagttcgtcgacgtcggcagcggaggtaaccaggcgtgcgtggccggtacggagcagctcgtgcgcaccacggctggtgacaggccccggcaccgcaccgacctggcgtccgagctggtgggcctcggacgctacccgaagcgcccccgatcgcgcgccggcctcaacgaccaccgttgctgctgacattgcctccaagcagtcgggagcgggctaggagccgatgccgcgtcgacacggatccgggaggaagctcgctggtcagcgcactcacatcacccacccggtccagcaagtcacggtggccgctcgggtcggggcggttcacgccaccgccaacaccgcacggtgcacagcagcctcgacaccattaagcgtcaccagccaccagtacacgctcacggttcgcgaggtcgccagccagctcggcggcgacatgctccccatacgcggaagccgcccgagaacccgtgaccgtcaccagatcgttccacggtcgcgccaagaacgacgccgcgccccgcacgaacagaataaacggagcgcggtcgcccagatcatccagcgcctgtggccagtgcgcgtcacccggaatcagagtggcgatcccgctctcctcgaccatgcgcagccgctgggcgagcccatccagcctgcccggtgaggtgaggtggtcacgccacacctgaccatcaactcgactcagaccaggcacggtggtcgtgtcggtgtcaagcagcccgagcgtctcaacggcacccaggcggcgcatcagcccgcccgtgacgggatcatcaggctccgccaacagcgccagcaccacccgggcacgacgttcatcaacaccaagcccagcaacaccagacatgacggctcctcctcgaacagacttcgccgaacaggtgcgccaacgcagcccgcaggtgtcgcgacgtcctcagcccgtggaggctggcgaacgcggtaacattcgacagtcgcacggttcggcagctcgacacagcagcgtgctggtgttgctttggaggagtccacgggcctcgccccccacaacggtgacttcaatcgacattgtcgttgttggtgatcgaggtgtcaccgcagctgcgaacgatagtcttgatctggacaacgatttcgatgcggaggaaagcacatgaggctcacacgcttcaaggtcgagaaccataggcggttggccgacctcgacattgaggtgcgcgaccaccttgtgctggttggagccaacgacgttgggaagtcctcgctgctccggtgcctcgatttgctgctcggggcgagtacggcgcagctctactcccgtatttcggccgacgatttccgagcccccgaccaaccgttcgtgattgaagggactctcgcggacttcaccgatgtcgacaaggctctgtttcccgatgagatccacgtcgacccgaacacgaatccttcgcgtctggtgattaggctcacggcgactgtggatgagaacgagacggtggtgatcagtcgttcggcccccgagggcggaacaggacgccagctctcacgggatcaggtgcttggcctgggatggaagttcctcagcgcaaccgcccagacccgcgaccttcgggaagaccgaaagtcggcactcgacgacatccttcaagctgtcgacttgggtgaagaggaggccgcgttcgaagccatcgcaaagagcctgacgaccaccttgggtagctctaaggtgcttgaaggcctccgaggttcacttgctgaccagctgtcgaaggctctgccggacaaggtggcacaggatgacttggcgttcgtgcctggagctgctgccgacaatgacgtcctcagcgacgtgcggctgcaagtcagcaagcaaggcgtggcacccgatctttccgaacagtcagacggcacgcgagcgctctacgcgatcgccctctacgatctgatgagcgtcggcgctaacatggtggggattgacgagcccgagatccatctacacccgagcagtcagcgaagcctcgcgcgcctcctgcggtcgaacgccaaccagaaggtcatcgctacgcattctgccgacatcgtaggagccttcgatccagattctattgtcgttgtgcggggcggaggcgaagccgttcaacccaaggctggattcctgtcggacgatgagcgaatggcagtacgcctgtgggtgagggatcggctcgaaccactcactgcacgtcgtgtcgttgtcgtggaaggcatctcagatcggatcatcctggagcacctggccgacctcaccgaccgaaatctcgaccggctcggcgtgtccttgattgaggctggcgggtgtggcgacatggggccgctcgacaagctctttggtgccaatggcttccgtgtatccatgtcgcaactcatcgatgcagatgcagaagaggcattggcaaagaaactgggagtcgaagttgctgaccttgcaggccgatccgtctgggtctcgcgaagcgacctcgaagacgagtacgttcgtgcgctcggctcggacgccgtgtggacagcactccagtcaaatggccacttctcgaagaatgaacttggcaactgcgcagcaagtgggccggctggcacgcgtaccgagatagatgttgctgccttctgtcgacgaaaggcgtacaaagtaaatgccgcgctatcagtcctgccgctcttcacggcggcgaatgccacgcaggtgtcgtctatcgagagtctactcgaagagatcgtggcgtagatggtcagcccgactcagaagcagattgacattagggacacgcgggttctcgatcttcttgtcgttgctcctgcgggatgcggcaagacggaagcgcttgcattacgaatccaaggacttcttcaccgcggcgatgtgactgccccaaagaagatcttggtgacaacattctcgaaccgagcccgcgacaacatcagagaacgattggggtcctacctgacgccttcggtaatgcgcgaccgcgttactgttgtgaactttcatggactggcagcccggttgatcagagcgcacggaaatgttatcggcctaagtgaggaactacgccttccggagaacgactgggttggcgagcaactccgccaacgcaacacctcctggaatgaccgaggagcgatccagaatgcgcttcgtgagacaaagcaacaacctttcagcgacgcagcggtcgaagctgaacttgaacgactcggaaatgtcactgcacttgaactggaacggctcagaaaggaagaaggacgcctcacctatgatgatctgccaagacttgccgagctgattctcggttacgagagcgtcgcggacctctacgcgacacacttcggcgctgtcgtggttgacgaattccaagacctgactccccagcaactccgaatcgtaaacagaatcggttacaagcgcacaacctatggcggtgaccttgtgcaggggatctatggttttgcaggagcgcagccactggcaattgatcgggacatacgtgccgagtgcacctgcgtgatcgagttctctgagtcgcatcgatcctcaccggcagttctcaggacggtcaacgcccttatcccgatcacgtcgggacaggtactcaccgcagccaaccccgactcctggccttcgggcgggctcaccgggacgatcgtgcaccaatcggcggaatcggaagctaagtgtatcgtgaaaattgcgcgagccatcctcggcagggctcccgggcatcggattggagtgttatcccgaacagcgccgcgtcgccgattcgttgacgcagccttcgccgcggcaacagatatacctcactacaggtgggatgacggcgtgttggacacagatactgccaaactcgtaaaggcaatgctcgcgaggtttgatgtcgccgcctacactgccgcgcccgacaaagtaactttccttcggatggcggttgactttgactcgatcactgatgtcgacacgcgcaagagcatggcggatgctctcggttgggtacaagatctgctgtctaaagcggtgaagccagagagcatccgtggacgcatcaaggttggcgattcagcgaccctcatcactagccctggagtccatctactgcgcggacacgtcggcaaagggcaacagttcgactgggtgattgtcgtaggccttgaaaagggctccattccgttcactatggctgacacatcagacgacgagatcgctgaggaagcacgagtgctttccgtgatgatctcacgcgctcggcacggcgtcattcttagccgagccaactcggttcggacgaacggggggcaccccatgagtcgaactccatcccagttcctcgaatggattgccactgccaatccactcgatgcgactgggatcatcgagtggttcaaagctgcggactggcgtgtaatcagtgagagatgaccaacgttctttggagagaagtgcgctgtccttgatgatgatccacctccgacccgcgcaaccttgggcgccggactcaccaggttgcagatcggatcagactggtaagcaagcgcccgtaaacctcgacttccctgaacacgggcccaggtcctattgaccccgttcagagagcacgagttcgtccagtcgcgctgcgcacccgatcccacgtcgtcagaaggtgagcggtagccagccagggtcatttacaaagcgctcagcgcgatctacagtagatagtaaggcaggttctcgtctcttgcgggtccatcgggacggcctacgggcgctcttccacgtactgtttcctcgacggagtagcacgtgtgacgagagagcccgatcatgttccgaaccatctggacgctcagcattcatgtcgatgactgtcttccagcactacatgccgagcaaccggctgctggcagctacgcgaactcggcgaggtgtgaagtggggtgtctcggcaatgctcgtcggcgtcccgtatctcgccatcgccaacgtgttcaactaccctgactgaccgttctgtggtgacgtgcaacggggtatcgatgttggtgtgcgcgaggacgttggttgtgggctcgttgtcgggtgcgtaggcggcgttctcgtcgttgtcaatagtgatgcgggtggatagggcacggttgaggattcgccgctcggctggcacgtacgttctcgactgtggccacggttagggcgaggtgtgctccaacggtgtcaacccctgggccaatgtgttgatgaggtcacggtgacgagtatgtggtcatggccgcacactccagattgatccggcaggcttccagggtggtgaacctcgttgaggggtccagctaagtacctaaggtcatggccaagcacgatcgcattcgctttgccgtgtgctctctttcggatcatcccggggagcacacaagatcgcccgaacaatggcgatcttgtgtacagtgactttgctagagatgttttcccaggaccgacagtgactgccagtgcgatgttcgaggtagtggtgaaactacgggtgtacaagatctgggtggccgtaaacgaggttgcctcttgggctcaggtcctgcctgacggaacccccctatctgagccctggccatgacgggtatgccttagtcaacgtggctgaagtgtcctgatatcgcagcatcagtgactagtttggtaactgtaatgccgccgcacccgttttacttactttcgatagaaagcgggtactctgtgcactttgcagggtttttgccttcgttgcttcccgtgcgacttactgtgtcttcttccttggggaggtgtaggggagggtagaatgttcgtggactagatcaacttaaccaacttacgggttgtaggttaacacctatctgtcaaccttgacactgtaatcccattgttcagcaggcacactgtcatacatctcactatctgtaaatgcagagcctgtggtttcaccaccaaagcctaactgccttaaatgtgcaatcccgttctgtgctccctccaaatcgatccgctccagtgtttcatcagcttcagaagcatagaggaacgtcacgctaacctacgatttggttctgggttgaatttttaggcgatctgatctgaagtttcgcgcgcctgcatagcccgatccgcaatctcgtccagcccgctgattatgtgatgcagctcacaagtagttagtaacaggacctgctccgcggcctggcctctatcggtgatcagcatgtgtccacggcatcttatccaccacgatgtcgcaatagttgcactgattctgacggcaccgccaacattcggtaagtgtaggataggacaagccttgagagtgtggatggaatgtgccaactctctcagtcctcaaagcatcagtggctagatcaacaaacatcgtaaacaggttgttctctcttatagcgatgtgtctatcgaagcagatgaacgagtcatctgccaggtatgaatgattgccatcactagtaacctctgcgtacggcagcaagacgttactgatgtttgagattaggagatccccaaaaatagatactcggagcgaaatagtatctatacctacgatgatgccgtgaacactactggtttctcaagcaaccagatccgcacatttaaaccatgtgaaacgtccggtaaacattctgctgtaagtcacccaggtgaccccttggagaaagttatttcagggctatggggctcgggggtgcgagaggattgttcgttgctcatttcggattatctttcagagatgagcaaccgcaatcggcattgaccagaagcgggtaaccggttgaccctagacagacttatgtttggtattcgtcaagcccccatcgggcgactggaacctgatcaattagatgatttgattgctattcttagaagaatagtttcctagattttatagcacttcccctaaacgtctaagtatgccctaaatcgtagctctaatgcagatgggcgggcgaggacgttccgggaagcatcgtcaagagtgtcgatgtcgcctgctctagctaagactcgctgcctaggaaaatcctgaacccaagtggctcggtatttgggggtgtagttcctggcgctatcggtgatgtccatagcagtcttggcggcggacgtgttcgttaagtcaataggactccagctggttttgtactcgtaatcttcaagatcaacatcgattcttagctcagtattgaggatctcgatcatgaaactcgaatcagagggaaaacttaactatcatatgcaatatcttcttaagaagagcgcttgccgactacgttatcaagcgatcccacgagcaccaatctggtatcggtaaaagtgttcgcttttctcggcggaaaatccccaaaatgcttggatatttttcttgacggatgaacttggagaagcgctgttctaatgcggcgtcacgccagacagtgtgcgcccggcatcgcccaagcctgagtgtccgaaacatgcttgatgcgtgtgaagcgttcctgcgaccaaggctcagcttgctggggatgctctaattacttctgctgctcgatagtatgcgtcctaggatagacgttgacttgagttgaggttgtctggctcttcgggcctgaggtggggcagctagtcggggcccggtgcggtgaggggtcggggttattcggcaggatcagcagcgcccaaactcgctgctccaagaagaccccgactgtgtgtgagcctaccaactactgccctcgttgtgatgccctaacctgcccggtctgtacgtgaccgacgtcgagcgcggacccgatacgattatggtgggggtgaagttagctccgggcgaggggttctgccccgactgcggtgtgctcgcgtctccccatggccgccgccgggtcctgcacgatgtttcttcggcagtatggcggtcgtgatcgggtggtgtacacgcacgtggcgctgcctcgaagccttgtgtagcaagggctctttcacggaacaagatcctgggatcgccgtactgtgggcggtgttgacccgccgtgccactcgatgggccgtggggcagctgcgccgagaacgcgtctcagtgctgggactcgcacgccaagctcagggcgactggaagactgtctggcgggcggtcaacccggtcttagaggaggcggacgctgacccagtccgctttgcggggatgcggcacctgggggggtgagcacgtctggcacgacaagaacccacgaacccggggaccgaagatgctcaccggcatagctgtcttcacgcacaccgacgacgtcccacgggcccggctgttagacctgaccctgggccgctccggaaccgtgtatggcgtctggctccagtaacgcggccaagcggtggcagcaggtcgagatcaccgcgttggacccgtttcgcgattacaagcacgctatcgatgatcacctcgataacgccacagccgtactgagtcccttccacgtcgtgaaacttgccgcccaggccctcgacgaggcccgacgccgggtccaacaagccccctcaggcaaccgcggccggactagcgacccgctctacggcattcagacgatcctgcgagccggggccgagaacctgtccgacaagcaaaaacaccgtcttgccaccgtgatcgacgctaacgaggcacacgagaaaatgttcattacctggcacaagcagcgtaacggctccgggccgtcaacagaccgatcgaactctaccgccgcatcgcccgtggctccagcaactgcgacaactaccgcctactccgctgctcatcgccgggggcaacacacacgaaccaccgccaagtcagacgagccatttatagcccaacagctatttgggtgatctcctcagcctgacagcgccagacgtcggtccgccatgctaagctgaacgcgtcgcttaagcttcgggaatagaaatgggaaacggtatgactcaaatacttattcaaatactcccggaatagacattcttgcggcgcgctccgctctaatcatttcgtggccgcctctcctacgacgaattgtgcattagggaagtacagtgcatctcagtccatatgtagtctttcgcaggacacgactcgcctactctcaacttcagagcagctccttcgacgcactctggcagcaagtgcaagaaatggtcgataagcatgcgcaattagaggttcagaccagcaggcttacggcacacctggagtctgttatttcagtaactgcgcctcgtgacagatctcgactaatcacattaaaacgtgacgtgcataacatgcgcgtggaaaaagtgaagcaaagactactgcactgtcagggctgcacggctagcaacattatggagcctgtatctagttggatcgatacatgtcgatcatacgaaatacttgagcgtcggttgagtcaagtatatgcggacagccgagacgaagtgtctcgtcactacaggtccctctaccaggctgacgcaatagagccaagcattcaactctcaggtggccagctccacagtgacctgacgcgtctgattagccacggttctaggataaaacccactaaagagcggactctggaaacgactcttgtaaactatctctacagggcagcaacaaagccatcacctttcggtcgtttcgtggaagtaggggccttcgacccgtctcaaccaaattccgaacctcgacgctgcagtgaatccagcgtgacgacaaaccggattcttaccagctggctcactgcagtaacagcgcgttctttcgccgcaccagaaatgcttgctatcctcaacagcaccctgcgcgttaaacgcgatataatccagttcattggaattccacctggggagtggcgaggtgcaccgagcattcccgaggagcgcctgctaactatccgcaagcgcgaagatatgatgtctgttcttaagctcctaatgggcggcccaagatcagtcggtgacctcattattgcccttaatgaccaaggcatagatgaatcacacgcaactaatcttctcagcagtttgagtacagcagggataatcttctttcggctcccagtagatgaccatgacgtacactatgtacagactgcgtgtacagcgctaaggttaaccaaagatgagtcacttcgtgccgctttccaaagtctggcgaacgctgaaaaggagttccccacagcgtcagtcgccacgcgtcacgaccttctcctcagcatcaaggattccgtgaatactgtcgcgtcggcacatgatgtgccggccccaccggacagcgtactcaagagccctttgtatgaggacctccccgccaccgcggcaccccagacatgggattcgaacacggttgagagatcagcccgcgcactcaggagcatctggctactgggcgatttaatggatagctctcaacgccgacagttgggcctctcccagttcatagcagacatgaataatggcgcgccagttacttttctggatttcttcgactcgttttcgcgccttagcattcgtgagcgccaaggaatcctgcgcggagaaaactcaccgcaaatcgcccgtttcgctcagcaatatagtgaagcattgcttaaaattcgcgatgccgttaactacacgcaggacgaagcccaccttgaatctcaggtaattctcgatgcgatcaccaatattgatgatttccgaccgactaagtcggtcacaattcgaggacaattcacaacatcgctcacctcccatataagccaactgataatcaacggtgttatgacgggatacggtacatacatgtcccgattcgcaacatttgtaaacccatcaggtacttggagtctagtcgacgggattcggagacatctatccgatcattttccaggtcaatgtgatttgaattccgtactgggattcaacttcaatgttcatccgcaaatgacagcacatagtatcgcctatcctggagtagttcctgtgcttaatggtgccaagacacattcgattcaggatttaatactgattccaactgctgaagcaggtccgcgccgcgtcgctatctttgatagagcagagaacgaacttatcgacctccagcccatgaatttcatggttccttttggggtgcctttgctgtatcggactctagagttcctgtgcccatcgaccagatacctatggaacccagctcaagaccttctggatatcccaatgatagagaacagttgccctcggatttactttgacgacgtagtggctcaacgccgttcctggacgtgcagcgccgagacgctcccgtgtcccccagagaaactctttaggggtgatcttgctgctttgcaagccttcgactcgtggagactatcagcgagggtacccagacatgtctttgccctagtacaaacggctacggaaagacaaattttttccggagcggccgacgcgccaaccttgctctccgaatacaagcatcttcggagagcaagtgtgcataagccaatctacctggatctacgaaacccacttctagtccgttctctcgcgaaggtgatcatgtccaggcccgaactatatgtcacgttttccgagttcctcccatcggaggccgattacacgcagaacggaagctgccccagttacgcagaggagtacttcattgaactgtgtgccgagtgacagcgcaagcatgtctgatcctggcggctggcgggcgctccatattcacttgcctccctcggtgcagtccgagtacctagctgacgtgattcttccctcgatgtcagccttgatgccagaacatgactacttcttcctccgatattggcaggggggatcacatctccggcttcggctccgtagcactcccgagcgccccctagatgatgaggctatcaacgaggttgcatgccatctccgtagccttctcccggcgttgtcagaccaaaagcgcgcggagtaccgctattcgcaatcgcttcaggatcagttagccgaaatggaaagggctgattgccttcccctagaggcggttgggaccgtggtagagcgccggtaccagcctgaatatagaaagtatggcggatcggtcggagtatccattgcagaggatgttttctgtagtactagccgatctgtccttcgcattctaagtgagcgaccaactagccaccgacagcccttggggtatgcttgccaagttttcatccagatgctgggctgcttagggctcgcaacttcgcaggttgaccagttcctcaccagatatgcgcagtggtggaccccttactcaatggccgctcgccctgagatcttagcggcgcgtctctacgccaacttgtcaagcgtggtggcggacctatgggccgcaagtgagcccaacggaatgttctcggttccggctctcaatgcttatacccaatggtcacggcgacggtcgtccgcgagaaataccagcgtaaagatagacccaatgtttctatcttgcttagcgaactacattcacacaaccaataaccgacttgggctcccacccgccctagaatcgacagcggcatatcttgtccaacttggattccgatcggtggctgtcaggggggagaaagtgcgatgaatccaaaaaactccaaagtgacggaactttggtttccagataattcagactcgccatgtactcttcttctcgacttatctcgggcctccgctgagggcactgagcctagtcctcaatactactgtcgaacttgggacccaacaacaaaagatcccggagtaagggttggcatacttgatcccaaccgcttaactcatcaaacggctttccttggcggttccggtattacgcatcacttcttggtaatggaaaaaccacccagctggcctcttctatggaacgcgggtttcgcgggcttgaagctttccacgataagcaaacaattgttcaccgcgtcatatccatggatggtaaagtgggcgctacaggcatcggcttggacggacgacgaacgccttctggctcttacgaaacttctagttgcccacgctgatgcaagccttccaccggtcgataagactgaaatgctcggccgcctccctttgaagttgagcttgcgactgatcacatatcgttcccactacgaaagcatccgcgctcgcacgattgacccgaaagcgatggatactgcggttaatcgggccttcatgaagtatcaagacgagctcctgcgatggtcccagtcgttgacatgctcgtcgagctatcgtgagaaagaatggagtaatcccaacctttcagaatggagcgccatcatttattgccatctcccacaaattaggcaactcctcagcgggggaggattaactgtcgcgggcccgacacgcgaggatatagaagcctccttaggtcacagtattcctgatacacgatttcacgagcgtcttgaccccgccatgcagtattatctcaatcatgaccaagacttcacggcatacagattctgcacgggttttttgtacagcaacctgtactcgctaggaataccgttgaggctgcgctaccttgtctgtgggttggcagcacgtttcaacgaggagctgtcggacacgacttggcgcgatttacgggatctcttccacgaggctgctactgttgcatattacacacgcgacacagacgggagcgggattagataatgacagttgagcgtcagcctctgcgggagcgtgcaaggagcctcgtttcaccatacggactagtttcccaagtacaccctctgcacgccaatgaagcagatccaccgtttcatgtgcatttgggtcgaacaggccactcaatacacgaggggcaaattacttttgagggagatatcggaaacaccgacggggcagggtcgggatccgacagtaccacggcagaatttattgcagtaatggagtccttagagcgctactccagcgcaatgtgggacgctcgttcctttttgctggaatcggaaaataatctgcaggagcgacttgtatctcccaaccaattcccacgctgttctacagccgagctagattctggacatgtactcaggcggtacgacccgggcgtcccaatacgatgggtcagaggatggtcactgacttcaggtcatcaggtgtgggttccggcgatcgcggtttatctgcatctgccgtacttaaacgactctgaacgattcatacgttcagtctcgaccggatgtgcggttcatgaatccatgcggaaggctgttcttaacggtcttttagaagtcgtcgagcgagatgctattgctttgacttggttgcatgagttgcccttgcccagaatcgcggctagcgaggccggtgagttcccgccggaagcgctagccagttggaagtcatatagggattacggaatcgagacccatctctttgacgcaacgacggattttgggattccggtgatctttgcgctccagatatcggatcaggatgacgacatcgctcagctcgtaggcgctgcatccgctttggaacccgctgaggcgctgactaaagtattcagggaaatggcatcgatccgaatagcactacgcgcctttctcgcccagtccacatcgattaagatttaccccgatgtggctaacgtgacagggggtgccgccctcatgggccagcgcgcgtaccgagatgcattttccttcctccttaacagcgagcgcgaaacgtcaccgtcgcggatgcctaacctcctagagctgaatgatgatccactgcgcgagatgattattcgaatacgcctggctggcgctgaagttatcgccgtcgatatcacgacggacaaagcgaggtcagttggtgcaagagtagtgaaggttttggtcccagaggcggttccactctcctttgttcaccgagagaggtatttagatactcctcggctcatatccgcgcctaatagcatgggatatttggttgacacagcgcctacgttcaaccggaacattcaaccttttgcgtgaaactcatatcaaggaaggccagaccgactaatggaccgcttcgttgtgactcggacgctcttcggcgtggagctcgctaaagaactccagtcctccatcttagaggatgggccatacataggcgactcagttcctcactggaaacaaaatcaattactcgtgtacgtgacgacagatgaggcatccccaaggttggactcaattgacggcggggcgttctcagctggccggccttggctccccgtccgtcttcgacccacagtgattcactgcggccccataatttggccaggtagtacgccttgcttccggtgcagtgtgaaccgaatgaagcagcactctcccatgcctagtctcgtaggttcaggaccggagcttgtggaaggctatgcggcgtttcatgtcagacttatagcggcagcgatctcgttgctggaggagagattctctgagggggagatcttaggtaggggcttatcatttaatcttgtcaacgggtttcttaaccactatcctatcgtgcccgttgatcgctgtccgagatgcggtggccgtttcggtaaacgggaagatgagcaccaagagttgggctgcgtcgcacgggaggtgtgtcaagtatgaagggtataatcagtggtgaacaggtgggaaatgcagctcgctttgacaagcagttcagggtccctcgtcggccgagcaggcggctcggtgtcgatattgagatccgtgaggatgcaacaattctttggggatcagatcgtctgcagacatttacaggaggaatgaaaccttcactgattgaggatattttacgagcgtgcgacggaactaagacggcacgtgagctcgcctctgtatgtgatgttacggagcccttgatggacaagatagtggcccttctctgggtctcgggtgctattgaggaggcgggcccgaccgatgttgaaagttctccgcttggggtccttttgtctcgccttgggaacgcaactggggcgaatgctagctggcaggaagctcagcacagaattaacagcatgccgatctgtgttatgccccattcggaacttggaacggaggttgcgggcgcgcttgctggcacctttgaggttatcaatgaagaggcagcttttgaacgcggcgtggttctattcatctttatcgaaaccgcgtcgtctaagatcgaacagcatcacaaatttgatgaactgacaaagagaagagtgctattggttagcgctgcgggtgacgaagttgtagtggggccgctttatgaccaggctataacgccctgccttcggtgctgttcgtcatcgaggatcaagctggatcggggtgcctcgagcccggcgcagcttcgtctcatggctggaattgtctcgcatcatattgttgcgttggtaagcagggcgttactctcaccgctgcccacggattccttggcgctgaatgtggtcactggtgtccagcgctactctcccccggtgtccagaccgggttgccccgaatgttcgcatgcgatcccagctattgctagtgagccgacggtcggtgccgtgtacgaggcttccgtagcactccctccgcgagaattcgtgaatgtaagggactatcaagcccacttcttgagcgcaaatcaacaacttcaaacgaaatttaagtcatggggaaaaagggaaaaattccctttgcctgacattaatatttcagacctacatatacagattgacgaccttctttttttagctgctgcccttaggtttgggttcggaatagacccggagcggaccacttcaaaaatagcgaagcgctggacggcctctggtggaaacattggctcggtaaacgcattcgtgagccttcctgcgatggtagggcacattcccagtgggatttatggatattcagttagcgatcattccctagccaaagttagtcaggagttgatttcggcgactgacatcatgatcgcggcttctgccgacctacggaagatcgcttctaaatatgggacattcggcttgaggatcgcgattatggacgccgggtgtgccctttcaacggtgcgtcgtgtctgccgggaagtaggccgtacattttcgatgtggagcgctgacctcgacgctgggtctattagcgagatgctgcatctttcaagtgcgcgtgagcctattattggagtttcagtgctgggaaaggggcaacgagggtgaggacagacattcccgtaatgaatgccattctgtgtggaatttctggtttgaggccgagagttgcggagctccggctgaatcatgtaccaggagaacttgaaggtgacctgatcggcgagttctcggggccagttactccggatgaaggatcaccttgtctgccgtgcaagagcttccccgaattcttgcagacaaggaggtcggtatcccattttagagacgaggcggttgacgcacgctgcgtcatccatgcagtggctcaggctcttgaggatgatgagcgactgtgggggtgctcagagaccgctggtcttcttgaggcgtttgtctttgtgcttcgagatagtgttggcggtcctggaccggggatctatcaggtgcggcgcgattctgcggtgagaatgacaactgccgctgaacttggcgatccgattcgattcggtgttcaggaggaattcttcgcagggtcaggggtagttatcttttgcgcgaatctggacgtggaggatggcgccggaggagcaaacggatacttagttaatactctccgagcttccatggcactctacgaagtccatgttgaactcggttgcatggacgtggttggctccgttttcggaggcttcattccagcttcgctgcgatcgctcctgttggcagatatggttactcgtcagcaaatcatctcttgctcctatggttttccagcctaacttgctcgacccgccagtagctgggttgtgaattgggtaatgaatggatcgaaataatttgtaccatctgagtcgcgagaaggtaaatacaaatgaaaatgaggcacttaatctcaatgtgatggagttctcggacatgattagcgacgctactgagcgcgacgacgtcactcagataatggcggcatcttgcgtcgagacgagtgtatcgtcgagttccacgtcatcttcatgatcgccaagtggcagattatggagccaggagaagaggtccgtacagggcgaatactcagacgcgacttagccttcgcagttgtcgtggaagtttatctagccgtcttaggttgtttcagcaaccctacacgggaagatactcttagcgctctggggtgggattatttggttcgccaaagcgattcaaggcttcctctctaggcggttatgattagtgtcgaaaccaattgaggggaggtgaacagaatggagaacgaaacgttggaccttgacgtgatggagctggccgatatcatcggtagtgcttctgatcaagacgacatggctcaggtcatggctgcgtcgtgcaccaccacgagtgtctcgacgagctcttcgtcgtcctcgtaacgagatgggcgggctggcgggtgcttttcgggcccgccggcccgttcctttgttatttacggttctttgcttgagcgggctgaatcgtggtggggaggttgtctaaaatttgggctcgggctcgaggccggccgcgtaaattgaccacaatgagcgtgctgcggtaacttagacgtaagatacgcttctcctgctagccttatttgttacccgtttggatttcacctagatgcacgctagggtaggctgattagcttttatggaaatgatattattattatgataattagtgtagatgggatttggaggggcatcgtgtagctagtctcaaatagaagcgatcccgcagtgcagcgtattttggatatgtccaggccttcgttcaagctggtttgatgtttttaaaggatgtggtgaccgttcacattgcgcatggctgccggtgtgcacattgttgagatgtattcggaggctggaaaggcagcggctttttcaattgacgcgtatgcaaccctgggggttccatatcgagaaatgtcatcattgttgttgtcgtaagtattcaaggtgggtaagcgccctgagattttcgctgttgatcgggtggcgcatgaggctaatgccggcgtaattgatccgaagctagatttggttgttttgaacagtttgcacaccgtcggtaatatgggggcgataatttagacctcctttgtgcttggctcaagggcttttgttctagtggacagaaacttgagctctatttccgataggagggttcttctggcttctcctagatacgtctttcttcttctggttctgagagctagtcgcgatgagcttcttgagttgtgcaccagtcgtcgggaactggtgaaattcttggcggatggctatgtggatatggcctttttctggtcttgagaccatccgatcacgatggtctagggaagcaaggataagggtgtgtcgataatttgattatcggatttccatctccgttagaattctgatgctggcggatgctaagtcattgaatgatgtgtctgtggcggtcggaattggactacatgagaggccgcagcgtgacttggagagcggatcttaggaatcagttcagggccaggactcccatccaggccatcagtttgttggcgaagctgacgatcagctgcccgatccagttctgtgtgaagccttttcaacgacagatcggtcaggctggtgtccttcgctgtcagggtcaggtctaacagccgggcccgtgggacgtcgtcggtgtgcgtgaagacagctatgccggtgagcatcttcggtccccgggttcgtgggttcttgtcgtgccagacgtgctcacccccccaggtgccgcatccccgcaaagcggactgggtcagcgtccgcctcctctaagaccgggttgaccgcccgccagacagtcttccagtcgccctgagcttggcgtgcgagtcccagcactgagacgcgttctcggcgcagctgccccacggcccatcgagtggcacggcgggtcaacaccgcccacagtacggcgatcccaggatcttgttccgtgaaagagcccttgctacacaaggcttcgaggcagcgccacgtgcgtgtacaccacccgatcacgaccgccatactgccgaagaaacatcgtgcaggacccggcggcggccatggggagacgcgagcacaccgcagtcggggcagaacccctcgcccggagctaacttcacccccaccataatcgtatcgggtccgcgctcgacgtcggtcacgtacagaccgggcaggttagggcatcacaacgagggcagtagttggtaggctcacacacagtcggggtcttcttggagcagcgagtttgggcgctgctgatcctgccgaataaccccgacccctcaccgcaccgggccccgactagctgccccacctcaggcccgaagagccagacaactcttgttgagcttcaaagccatgaaatcttcggtctgcttcttaatgccagtctctgccgggaatcgctcgatggaagatgcgccgtagaagcctacgatgccatcggtgtgatcgagaatgtattgcgcatcctcgggattggcgatggggccgccatggcataggcataggatgtcgggattgacggatttggcggcgtcggcgagttcctgaaccttgacagcagcatcctcgatagtgagtgctgtttttgcaccaatggttccggaggttgtcagacccatgtgggggacgaggatgtcagagcccgcccgggccatatccttggcctggtcaacgtcgaaaacatagggtgaggtgaggagatcaagatcgtgggcaattttgatcatgtcgatctccaaaccgtaccccatgccagtttcctcgaggtttgcgcggaatgtgccatcgatgagaccaacagtagggaaattctgcactccggcgaaccccgcggctttgatctgggttaggactggggcatcactctgaagggatcagtgccattaactccggcaagaactggggtgtgcttgacgacgggcagtacctcgcgcgccatgtccatggcgatctcattggcatcgccgtaagcgagaagccctgagagggagccgcgacctgccatccggaaacgtcctgagttatagatgacgagcagatcgataccgccggcttccgcggatttaaccgtaatcccggtgcctgcgccgccgcccaccaaggggattccgttggcgacttgtccgcggaactttttcaggatttcagtgcgggtcatgatgctattcctttccgattagttatggatgatgagctcgtgaagagcccgcgccattgcttcgccaaaaccagaatcattgatattttgttttcgctcagtcacagtgatgtcggtatcctttattccctctcgaatggcgttgaacaaagcgtcatcggcttctggatcatagaaatcttcacctggggtatctattcctgcgacccccagagtaggaatgaaagcttgagccgggccgcgcgcagcggccgcctttatggcgattctgtgaccaagctcggccatttcggtgttgctcgtttgagcgtcaccgctggattgtggatatgcaacgtgcgagaggaatagcgctccggaatagtgtcgacagggccgaaattgaccatgtcaagcgcgccaagactgatgacttcgggtattccaaggtctgctgcggcttccatccggcggggtcctgccgagagaactcctccgcagaggtcgtcggcaagctcggtagtcgtcaggtcacatattcccgcgagtagcccagacgatgcgagcttttctatcgccttcccctcccggaatcagttgcgtggaagacgaggacctcgtacccaaggtctgtcaaggtcttgcgagcttcgtcagcagccggcgttgtcaatccgaacatcgtcaggccgacgaccggtttgttgtgagcggggttgctgacggttctaacgtcttcatactccttggccatggctgtgatagcggcggctgcattggcgaagaccatgagcgacacggaattgatgccggccacgtcaacgacggagtacataagtgtgacgtcggtttgtcccacgtaggggctgacatctccggaagccatcgtggaaaccaggagcttggggaatccaatcggcaatgtctgcatgaccgaagccgctacggatgatccacctgatccgccgagggacaggagaccgtggattttcccctcttcggcaagcttggatgcaataatcgaagcgccacggcccatgacatccatcatttcgccacggttatgacgtgttcggatgtcacttggcgactcgcctgcggcacgaatgacctcatcggacgtgtagtcggctatacggctgttggagaatgagccaacatcgatgatgactacctggctgccgttggtaagaatgcggtgacgaagccagtcgaactcgtctcccttggtatccaaagttccgagcaaagctattgcggccatgaacactccttcgtgatcgtgtcatcatgaccgtagttcggtgattctgcctacaccatgccgtttgagacgaattggcctgtacgttgtatcgctggttgtgaagaagggcaatacttcaggtgtggttgtcaaggttgaccctgcaagtctgagccggatgctgggggagtggagccagcccggagaagcgcttccggaagcgttggcggacgcattgctggatctcattgacgctggttttgtgcccgctggtgcggttcttccaccccaacgagcatgcgccgcgacactgcaagtatctcggcaaaccgtggcggaggcatttgggattcttgaagccgcaggccacattgcggcgttggttgggtcagggacgcgggttagatcaggccgcgctgcagtgagtactgatggcaggttgttctcgttcagcgaggctgcacctggcctgatcgacctgtcaacgggggcgctacctgcgtcagaggtggtgcgaagagtgcggctagaagaccacgtcgacttggatgagtatttcgataccgacggatatttcccggctggactacctatattgcgtgcagccatcgcggaacggctcactcgagatggagttcccacagtcccgcagcagatcgttgttaccaacggcgctcagcatgcgagttatcttgcctctcagctcctggtctcggctggtgacaccgtgttggtggaggagccgacatatcggggtgagctcgcagagctgcgactgatgggcgcccgtgtgaagagtgtccc

SEQ ID NO: 56 - DNA, 26003 bp, Propionibacterium acnes
cccgctcactgccaacgagacatcacgcagcagcggccgaccatcggccagcgtgtacgtcaccgacgcgacatcgagacgaaccatgacccaaaagtatcacacgtgtgataaatggaggttgagtatggcggcctgttcacttgatcaggcatttcttttagtgaggcctggggcgtaaccacttgtctgcaccttagagctgccacgcctcttgcagatcgaggcagaggaggctgcgcgggggtcgtggcgtgcggtggcggggtttgatgtcacgttcagtgtgccgaagtcggcatcggtgttgtgggcggttgcggacgcggggacgcaggcgttgattgcgcaggcccatcatgagacggttgtggcggtggttgcattcatggagtgcgaggttgcagccatccgcacgggtgcaactgctggggatggcgcggttgcacaggtcgacgtgacgggtttgatcacttcgattcccgcgccggggacccgcacttgcatacgcatgtggtgatcagcaacaaggcccgcacggtcctggatgggaagtggcggagtttggatgggcgttcgatgcatgccgcggtcttggcgctgtcggagctgcacgaggccgtgttcgccgatcacatgacccgcacgttcggtgtgacgtaggagccgcgggagatgggccaggaccggaacccgtcgtgggcgatcaccgacgtccccgaacagctggtggcagagttctcgacccgcgcccggcacatcaacgaggcgaccgacgcgctggttgctgactacgtggcccagcacgggaagcgcccttcgccggcgaccatcatgaaactgcgcgcccaggccacgctcgcgacccgtccggagaagcaggtccgctcacttgcggagctaacagccgagtggcgcactcgtgtcagccagcagctcggtgtggatgccaccgtgtgggcgcggaccgtcacgggtggggagcggcagttgctgttgcgggctggtgatgtgccgttggatctgatcgaggggtggggcggtctgtagtcgagatggtcggtgagaagcgttcgacgtggcggtgctggaacctgatggccgaagtcgcctgccagactgtggggtggcgtttcgccaccgttgaggaccgcgaagtcatcaccgcgatggttgccgacgcagcggaacaggcgtccttacgcctgaccccacccgagctagcgaccagcccggcgaagttccgccgcccggacggcactagcgtatttcgtccgaagcactccacggtgttctcctccgacagcctcctggccgcagaggaccacctcctgcaacgggcccgcaccgcgaccggtccgactatcgacctgaccaccgtggggaccatcacgagcaaggcggacagcgagggtcgggtgctcggtcccgatcaggccgcagctttggcgtcggtcgcggtcccgggccgggtggtggatgtgttggtggggccggcgggggctgggaagactgcagcgatgaacgcaccgcgccgggcgtgggagacggagcatggtgccgggtcggtggtggggttggctccgtcggcggtggcggcccaggtgctggccgatgatctgaggattgccacggagaacacggcgaagtggtggaccacccaccaacacaccggcgtcactttcaaggctggtcagctggtcatcatcgacgaagcttccctcgctgagaccctctctttgaatcggatcacgctggctgctgaggaggcggggacgaaggtgctgctggttggcgactatgcccagctcccgtccgtcgatgccggtggtgcgttcagcctgttgatccacgaccgccacgatgcccccgagctggtcgatgtccaccgcttcacccacgcctgggagaagaccgcatccctggagctgcggcacggccgcaccccggtcatcgacacctacctggcacaggatcgcatccacgacggagacgccgaggccgtgaccgctgccgcttacaccgcctggcgccacgaccggcagcaggggttggcgtcagtactgatcgccgaaacccgcgagaacgtcaccgccctcaacatccacacccgcgctgacctcatcctggacagcacgttgaagcctggccccgaaatcaccctgtccgacgggtccatggcaggcgtgggtgacacgatcatcacccgccgtaacgaccggcggctgcggaaccggcacggctgggtccacaacggccaaacctggaccatcactgccgtgcgtgacgatgggtcggtcacgatccgcccacccagtgcccggttcggcaacagcatcgtcctacccgccgactacgtggctgagcacgtcgacctcggctacgccgtcaccgctcaccgcgcccaaagcatcacaccgacaccgcccacgtcctcgtcgaacccacggcgacgcgggaaacctgtatgtggctatgacgcgcgggcgcgaatcgaaccgggcctacgtcatcctcgaccgtgccgacgaccacgccgccggcgccgtgtgccgtgtgaactcggtcgacagccccggacgctgggtcgcgcggtccgtgatgagttcgtcgacgtcggcagcggaggtaaccaggcgtgcgtggccggtacggagcagctcgtgcgcaccacggctggtgacaggccccggcaccgcaccgacctggcgtccgagctggtgggcctcggacgctacccgaagcgcccccgatcgcgcgccggcctcaacgaccaccgttgctgctgacattgcctccaagcagtcgggagcgggctaggagccgatgccgcgtcgacacggatccgggaggaagctcgctggtcagcgcactcacatcacccacccggtccagcaagtcacggtggccgctcgggtcggggcggttcacgccaccgccaacaccgcacggtgcacagcagcctcgacaccattaagcgtcaccagccaccagtacacgctcacggttcgcgaggtcgccagccagctcggcggcgacatgctccccatacgcggaagccgcccgagaacccgtgaccgtcaccagatcgttccacggtcgcgccaagaacgacgccgcgccccgcacgaacagaataaacggagcgcggtcgcccagatcatccagcgcctgtggccagtgcgcgtcacccggaatcagagtggcgatcccgctctcctcgaccatgcgcagccgctgggcgagcccatccagcctgcccggtgaggtgaggtggtcacgccacacctgaccatcaactcgactcagaccaggcacggtggtcgtgtcggtgtcaagcagcccgagcgtctcaacggcacccaggcggcgcatcagcccgcccgtgacgggatcatcaggctccgccaacagcgccagcaccacccgggcacgacgttcatcaacaccaagcccagcaacaccagacatgacggctcctcctcgaacagacttcgccgaacaggtgcgccaacgcagcccgcaggtgtcgcgacgtcctcagcccgtggaggctggcgaacgcggtaacattcgacagtcgcacggttcggcagctcgacacagcagcgtgctggtgttgctttggaggagtccacgggcctcgccccccacaacggtgacttcaatcgacattgtcgttgttggtgatcgaggtgtcaccgcagctgcgaacgatagtcttgatctggacaacgatttcgatgcggaggaaagcacatgaggctcacacgcttcaaggtcgagaaccataggcggttggccgacctcgacattgaggtgcgcgaccaccttgtgctggttggagccaacgacgttgggaagtcctcgctgctccggtgcctcgatttgctgctcggggcgagtacggcgcagctctactcccgtatttcggccgacgatttccgagcccccgaccaaccgttcgtgattgaagggactctcgcggacttcaccgatgtcgacaaggctctgtttcccgatgagatccacgtcgacccgaacacgaatccttcgcgtctggtgattaggctcacggcgactgtggatgagaacgagacggtggtgatcagtcgttcggcccccgagggcggaacaggacgccagctctcacgggatcaggtgcttggcctgggatggaagttcctcagcgcaaccgcccagacccgcgaccttcgggaagaccgaaagtcggcactcgacgacatccttcaagctgtcgacttgggtgaagaggaggccgcgttcgaagccatcgcaaagagcctgacgaccaccttgggtagctctaaggtgcttgaaggcctccgaggttcacttgctgaccagctgtcgaaggctctgccggacaaggtggcacaggatgacttggcgttcgtgcctggagctgctgccgacaatgacgtcctcagcgacgtgcggctgcaagtcagcaagcaaggcgtggcacccgatctttccgaacagtcagacggcacgcgagcgctctacgcgatcgccctctacgatctgatgagcgtcggcgctaacatggtggggattgacgagcccgagatccatctacacccgagcagtcagcgaagcctcgcgcgcctcctgcggtcgaacgccaaccagaaggtcatcgctacgcattctgccgacatcgtaggagccttcgatccagattctattgtcgttgtgcggggcggaggcgaagccgttcaacccaaggctggattcctgtcggacgatgagcgaatggcagtacgcctgtgggtgagggatcggctcgaaccactcactgcacgtcgtgtcgttgtcgtggaaggcatctcagatcggatcatcctggagcacctggccgacctcaccgaccgaaatctcgaccggctcggcgtgtccttgattgaggctggcgggtgtggcgacatggggccgctcgacaagctctttggtgccaatggcttccgtgtatccatgtcgcaactcatcgatgcagatgcagaagaggcattggcaaagaaactgggagtcgaagttgctgaccttgcaggccgatccgtctgggtctcgcgaagcgacctcgaagacgagtacgttcgtgcgctcggctcggacgccgtgtggacagcactccagtcaaatggccacttctcgaagaatgaacttggcaactgcgcagcaagtgggccggctggcacgcgtaccgagatagatgttgctgccttctgtcgacgaaaggcgtacaaagtaaatgccgcgctatcagtcctgccgctcttcacggcggcgaatgccacgcaggtgtcgtctatcgagagtctactcgaagagatcgtggcgtagatggtcagcccgactcagaagcagattgacattagggacacgcgggttctcgatcttcttgtcgttgctcctgcgggatgcggcaagacggaagcgcttgcattacgaatccaaggacttcttcaccgcggcgatgtgactgccccaaagaagatcttggtgacaacattctcgaaccgagcccgcgacaacatcagagaacgattggggtcctacctgacgccttcggtaatgcgcgaccgcgttactgttgtgaactttcatggactggcagcccggttgatcagagcgcacggaaatgttatcggcctaagtgaggaactacgccttccggagaacgactgggttggcgagcaactccgccaacgcaacacctcctggaatgaccgaggagcgatccagaatgcgcttcgtgagacaaagcaacaacctttcagcgacgcagcggtcgaagctgaacttgaacgactcggaaatgtcactgcacttgaactggaacggctcagaaaggaagaaggacgcctcacctatgatgatctgccaagacttgccgagctgattctcggttacgagagcgtcgcggacctctacgcgacacacttcggcgctgtcgtggttgacgaattccaagacctgactccccagcaactccgaatcgtaaacagaatcggttacaagcgcacaacctatggcggtgaccttgtgcaggggatctatggttttgcaggagcgcagccactggcaattgatcgggacatacgtgccgagtgcacctgcgtgatcgagttctctgagtcgcatcgatcctcaccggcagttctcaggacggtcaacgcccttatcccgatcacgtcgggacaggtactcaccgcagccaaccccgactcctggccttcgggcgggctcaccgggacgatcgtgcaccaatcggcggaatcggaagctaagtgtatcgtgaaaattgcgcgagccatcctcggcagggctcccgggcatcggattggagtgttatcccgaacagcgccgcgtcgccgattcgttgacgcagccttcgccgcggcaacagatatacctcactacaggtgggatgacggcgtgttggacacagatactgccaaactcgtaaaggcaatgctcgcgaggtttgatgtcgccgcctacactgccgcgcccgacaaagtaactttccttcggatggcggttgactttgactcgatcactgatgtcgacacgcgcaagagcatggcggatgctctcggttgggtacaagatctgctgtctaaagcggtgaagccagagagcatccgtggacgcatcaaggttggcgattcagcgaccctcatcactagccctggagtccatctactgcgcggacacgtcggcaaagggcaacagttcgactgggtgattgtcgtaggccttgaaaagggctccattccgttcactatggctgacacatcagacgacgagatcgctgaggaagcacgagtgctttccgtgatgatctcacgcgctcggcacggcgtcattcttagccgagccaactcggttcggacgaacggggggcaccccatgagtcgaactccatcccagttcctcgaatggattgccactgccaatccactcgatgcgactgggatcatcgagtggttcaaagctgcggactggcgtgtaatcagtgagagatgaccaacgttctttggagagaagtgcgctgtccttgatgatgatccacctccgacccgcgcaaccttgggcgccggactcaccaggttgcagatcggatcagactggtaagcaagcgcccgtaaacctcgacttccctgaacacgggcccaggtcctattgaccccgttcagagagcacgagttcgtccagtcgcgctgcgcacccgatcccacgtcgtcagaaggtgagcggtagccagccagggtcatttacaaagcgctcagcgcgatctacagtagatagtaaggcaggttctcgtctcttgcgggtccatcgggacggcctacgggcgctcttccacgtactgtttcctcgacggagtagcacgtgtgacgagagagcccgatcatgttccgaaccatctggacgctcagcattcatgtcgatgactgtcttccagcactacatgccgagcaaccggctgctggcagctacgcgaactcggcgaggtgtgaagtggggtgtctcggcaatgctcgtcggcgtcccgtatctcgccatcgccaacgtgttcaactaccctgactgaccgttctgtggtgacgtgcaacggggtatcgatgttggtgtgcgcgaggacgttggttgtgggctcgttgtcgggtgcgtaggcggcgttctcgtcgttgtcaatagtgatgcgggtggatagggcacggttgaggattcgccgctcggctggcacgtacgttctcgactgtggccacggttagggcgaggtgtgctccaacggtgtcaacccctgggccaatgtgttgatgaggtcacggtgacgagtatgtggtcatggccgcacactccagattgatccggcaggcttccagggtggtgaacctcgttgaggggtccagctaagtacctaaggtcatggccaagcacgatcgcattcgctttgccgtgtgctctctttcggatcatcccggggagcacacaagatcgcccgaacaatggcgatcttgtgtacagtgactttgctagagatgttttcccaggaccgacagtgactgccagtgcgatgttcgaggtagtggtgaaactacgggtgtacaagatctgggtggccgtaaacgaggttgcctcttgggctcaggtcctgcctgacggaacccccctatctgagccctggccatgacgggtatgccttagtcaacgtggctgaagtgtcctgatatcgcagcatcagtgactagtttggtaactgtaatgccgccgcacccgttttacttactttcgatagaaagcgggtactctgtgcactttgcagggtttttgccttcgttgcttcccgtgcgacttactgtgtcttcttccttggggaggtgtaggggagggtagaatgttcgtggactagatcaacttaaccaacttacgggttgtaggttaacacctatctgtcaaccttgacactgtaatcccattgttcagcaggcacactgtcatacatctcactatctgtaaatgcagagcctgtggtttcaccaccaaagcctaactgccttaaatgtgcaatcccgttctgtgctccctccaaatcgatccgctccagtgtttcatcagcttcagaagcatagaggaacgtcacgctaacctacgatttggttctgggttgaatttttaggcgatctgatctgaagtttcgcgcgcctgcatagcccgatccgcaatctcgtccagcccgctgattatgtgatgcagctcacaagtagttagtaacaggacctgctccgcggcctggcctctatcggtgatcagcatgtgtccacggcatcttatccaccacgatgtcgcaatagttgcactgattctgacggcaccgccaacattcggtaagtgtaggataggacaagccttgagagtgtggatggaatgtgccaactctctcagtcctcaaagcatcagtggctagatcaacaaacatcgtaaacaggttgttctctcttatagcgatgtgtctatcgaagcagatgaacgagtcatctgccaggtatgaatgattgccatcactagtaacctctgcgtacggcagcaagacgttactgatgtttgagattaggagatccccaaaaatagatactcggagcgaaatagtatctatacctacgatgatgccgtgaacactactggtttctcaagcaaccagatccgcacatttaaaccatgtgaaacgtccggtaaacattctgctgtaagtcacccaggtgaccccttggagaaagttatttcagggctatggggctcgggggtgcgagaggattgttcgttgctcatttcggattatctttcagagatgagcaaccgcaatcggcattgaccagaagcgggtaaccggttgaccctagacagacttatgtttggtattcgtcaagcccccatcgggcgactggaacctgatcaattagatgatttgattgctattcttagaagaatagtttcctagattttatagcacttcccctaaacgtctaagtatgccctaaatcgtagctctaatgcagatgggcgggcgaggacgttccgggaagcatcgtcaagagtgtcgatgtcgcctgctctagctaagactcgctgcctaggaaaatcctgaacccaagtggctcggtatttgggggtgtagttcctggcgctatcggtgatgtccatagcagtcttggcggcggacgtgttcgttaagtcaataggactccagctggttttgtactcgtaatcttcaagatcaacatcgattcttagctcagtattgaggatctcgatcatgaaactcgaatcagagggaaaacttaactatcatatgcaatatcttcttaagaagagcgcttgccgactacgttatcaagcgatcccacgagcaccaatctggtatcggtaaaagtgttcgcttttctcggcggaaaatccccaaaatgcttggatatttttcttgacggatgaacttggagaagcgctgttctaatgcggcgtcacgccagacagtgtgcgcccggcatcgcccaagcctgagtgtccgaaacatgcttgatgcgtgtgaagcgttcctgcgaccaaggctcagcttgctggggatgctctaattacttctgctgctcgatagtatgcgtcctaggatagacgttgacttgagttgaggttgtctggctcttcgggcctgaggtggggcagctagtcggggcccggtgcggtgaggggtcggggttattcggcaggatcagcagcgcccaaactcgctgctccaagaagaccccgactgtgtgtgagcctaccaactactgccctcgttgtgatgccctaacctgcccggtctgtacgtgaccgacgtcgagcgcggacccgatacgattatggtgggggtgaagttagctccgggcgaggggttctgccccgactgcggtgtgctcgcgtctccccatggccgccgccgggtcctgcacgatgtttcttcggcagtatggcggtcgtgatcgggtggtgtacacgcacgtggcgctgcctcgaagccttgtgtagcaagggctctttcacggaacaagatcctgggatcgccgtactgtgggcggtgttgacccgccgtgccactcgatgggccgtggggcagctgcgccgagaacgcgtctcagtgctgggactcgcacgccaagctcagggcgactggaagactgtctggcgggcggtcaacccggtcttagaggaggcggacgctgacccagtccgctttgcggggatgcggcacctgggggggtgagcacgtctggcacgacaagaacccacgaacccggggaccgaagatgctcaccggcatagctgtcttcacgcacaccgacgacgtcccacgggcccggctgttagacctgaccctgggccgctccggaaccgtgtatggcgtctggctccagtaacgcggccaagcggtggcagcaggtcgagatcaccgcgttggacccgtttcgcgattacaagcacgctatcgatgatcacctcgataacgccacagccgtactgagtcccttccacgtcgtgaaacttgccgcccaggccctcgacgaggcccgacgccgggtccaacaagccccctcaggcaaccgcggccggactagcgacccgctctacggcattcagacgatcctgcgagccggggccgagaacctgtccgacaagcaaaaacaccgtcttgccaccgtgatcgacgctaacgaggcacacgagaaaatgttcattacctggcacaagcagcgtaacggctccgggccgtcaacagaccgatcgaactctaccgccgcatcgcccgtggctccagcaactgcgacaactaccgcctactccgctgctcatcgccgggggcaacacacacgaaccaccgccaagtcagacgagccatttatagcccaacagctatttgggtgatctcctcagcctgacagcgccagacgtcggtccgccatgctaagctgaacgcgtcgcttaagcttcgggaatagaaatgggaaacggtatgactcaaatacttattcaaatactcccggaatagacattcttgcggcgcgctccgctctaatcatttcgtggccgcctctcctacgacgaattgtgcattagggaagtacagtgcatctcagtccatatgtagtctttcgcaggacacgactcgcctactctcaacttcagagcagctccttcgacgcactctggcagcaagtgcaagaaatggtcgataagcatgcgcaattagaggttcagaccagcaggcttacggcacacctggagtctgttatttcagtaactgcgcctcgtgacagatctcgactaatcacattaaagcgtgacgtgcataacatgcgcgtggaaaaagtgaagcaaagactactgcactgtcagggctgcacggctagcaacattatggagcctgtatctagttggatcgatacatgtcgatcatacgaaatacttgagcgtcggttgagtcaagtatatgcggacagccgagacgaagtgtctcgtcactacaggtccctctaccaggctgacgcaatagagccaagcattcaactctcaggtggccagctccacagtgacctgacgcgtctgattagccacggttctaggataaaacccactaaagagcggactctggaaacgactcttgtaaactatctctacagggcagcaacaaagccatcacctttcggtcgtttcgtggaagtaggggccttcgacccgtctcaaccaaattccgaacctcgacgctgcagtgaatccagcgtgacgacaaaccggattcttaccagctggctcactgcagtaacagcgcgttctttcgccgcaccagaaatgcttgctatcctcaacagcaccctgcgcgttaaacgcgatataatccagttcattggaattccacctggggagtggcgaggtgcaccgagcattcccgaggagcgcctgctaactatccgcaagcgcgaagatatgatgtctgttcttaagctcctaatgggcggcccaagatcagtcggtgacctcattattgcccttaatgaccaaggcatagatgaatcacacgcaactaatcttctcagcagtttgagtacagcagggataatcttctttcggctcccagtagatgaccatgacgtacactatgtacagactgcgtgtacagcgctaaggttaaccaaagatgagtcacttcgtgccgctttccaaagtctggcgaacgctgaaaaggagttccccacagcgtcagtcgccacgcgtcacgaccttctcctcagcatcaaggattccgtgaatactgtcgcgtcggcacatgatgtgccggccccaccggacagcgtactcaagagccctttgtatgaggacctccccgccaccgcggcaccccagacatgggattcgaacacggttgagagatcagcccgcgcactcaggagcatctggctactgagcgatttaatggatagctctcaacgccgacagttgggcctctcccagttcatagcagacatgaataatggcgcgccagttacttttctggatttcttcgactcgttttcgcgccttagcattcgtgagcgccaaggaatcctgcgcggagaaaactcaccgcaaatcgcccgtttcgctcagcaatatagtgaagcattgcttaaaattcgcgatgccgttaactacacgcaggacgaagcccaccttgaatctcaggtaattctcgatgcgatcaccaatattgatgatttccgaccgactaagtcggtcacaattcgaggacaattcacaacatcgctcacctcccatataagccaactgataatcaacggtgttatgacgggatacggtacatacatgtcccgattcgcaacatttgtaaacccatcaggtacttggagtctagtcgacgggattcggagacatctatccgatcattttccaggtcaatgtgatttgaattccgtactgggattcaacttcaatgttcatccgcaaatgacagcacatagtatcgcctatcctggagtagttcctgtgcttaatggtgccaagacacattcgattcaggatttaatactgattccaactgctgaagcaggtccgcgccgcgtcgctatctttgatagagcagagaacgaacttatcgacctccagcccatgaatttcatggttccttttggggtgcctttgctgtatcggactctagagttcctgtgcccatcgaccagatacctatggaacccagctcaagaccttctggatatcccaatgatagagaacagttgccctcggatttactttgacgacgtagtggctcaacgccgttcctggacgtgcagcgccgagacgctcccgtgtcccccagagaaactctttaggggtgatcttgctgctttgcaagccttcgactcgtggagactatcagcgagggtacccagacatgtctttgccctagtacaaacggctacggaaagacaaattttttccggagcggccgacgcgccaaccttgctctccgaatacaagcatcttcggagagcaagtgtgcataagccaatctacctggatctacgaaacccacttctagtccgttctctcgcgaaggtgatcatgtccaggcccgaactatatgtcacgttttccgagttcctcccatcggaggccgattacacgcagaacggaagctgccccagttacgcagaggagtacttcattgaactgtgtgccgagtgacagcgcaagcatgtctgatcctggcggctggcgggcgctccatattcacttgcctccctcggtgcagtccgagtacctagctgacgtgattcttccctcgatgtcagccttgatgccagaacatgactacttcttcctccgatattggcaggggggatcacatctccggcttcggctccgtagcactcccgagcgccccctagatgatgaggctatcaacgaggttgcatgccatctccgtagccttctcccggcgttgtcagaccaaaagcgcgcggagtaccgctattcgcaatcgcttcaggatcagttagccgaaatggaaagggctgattgccttcccctagaggcggttgggaccgtggtagagcgccggtaccagcctgaatatagaaagtatggcggatcggtcggagtatccattgcagaggatgttttctgtagtactagccgatctgtccttcgcattctaagtgagcgaccaactagccaccgacagcccttggggtatgcttgccaagttttcatccagatgctgggctgcttagggctcgcaacttcgcaggttgaccagttcctcaccagatatgcgcagtggtggaccccttactcaatggccgctcgccctgagatcttagcggcgcgtctctacgccaacttgtcaagcgtggtggcggacctatgggccgcaagtgagcccaacggaatgttctcggttccggctctcaatgcttatacccaatggtcacggcgacggtcgtccgcgagaaataccagcgtaaagatagacccaatgtttctatcttgcttagcgaactacattcacacaaccaataaccgacttgggctcccacccgccctagaatcgacagcggcatatcttgtccaacttggattccgatcggtggctgtcaggggggagaaagtgcgatgaatccaaaaaactccaaagtgacggaactttggtttccagataattcagactcgccatgtactcttcttctcgacttatctcgggcctccgctgagggcactgagcctagtcctcaatactactgtcgaacttgggacccaacaacaaaagatcccggagtaagggttggcatacttgatcccaaccgcttaactcatcaaacggctttccttggcggttccggtattacgcatcacttcttggtaatggaaaaaccacccagctggcctcttctatggaacgcgggtttcgcgggcttgaagctttccacgataagcaaacaattgttcaccgcgtcatatccatggatggtaaagtgggcgctacaggcatcggcttggacggacgacgaacgccttctggctcttacgaaacttctagttgcccacgctgatgcaagccttccaccggtcgataagactgaaatgctcggccgcctccctttgaagttgagcttgcgactgatcacatatcgttcccactacgaaagcatccgcgctcgcacgattgacccgaaagcgatggatactgcggttaatcgggccttcatgaagtatcaagacgagctcctgcgatggtcccagtcgttgacatgctcgtcgagctatcgtgagaaagaatggagtaatcccaacctttcagaatggagcgccatcatttattgccatctcccacaaattaggcaactcctcagcgggggaggattaactgtcgcgggcccgacacgcgaggatatagaagcctccttaggtcacagtattcctgatacacgatttcacgagcgtcttgaccccgccatgcagtattatctcaatcatgaccaagacttcacggcatacagattctgcacgggttttttgtacagcaacctgtactcgctaggaataccgttgaggctgcgctaccttgtctgtgggttggcagcacgtttcaacgaggagctgtcggacacgacttggcgcgatttacgggatctcttccacgaggctgctactgttgcatattacacacgcgacacagacgggagcgggattagataatgacagttgagcgtcagcctctgcgggagcgtgcaaggagcctcgtttcaccatacggactagtttcccaagtacaccctctgcacgccaatgaagcagatccaccgtttcatgtgcatttgggtcgaacaggccactcaatacacgaggggcaaattacttttgagggagatatcggaaacaccgacggggcagggtcgggatccgacagtaccacggcagaatttattgcagtaatggagtccttagagcgctactccagcgcaatgtgggacgctcgttcctttttgctggaatcggaaaataatctgcaggagcgacttgtatctcccaaccaattcccacgctgttctacagccgagctagattctggacatgtactcaggcggtacgacccgggcgtcccaatacgatgggtcagaggatggtcactgacttcaggtcatcaggtgtgggttccggcgatcgcggtttatctgcatctgccgtacttaaacgactctgaacgattcatacgttcagtctcgaccggatgtgcggttcatgaatccatgcggaaggctgttcttaacggtcttttagaagtcgtcgagcgagatgctattgctttgacttggttgcatgagttgcccttgcccagaatcgcggctagcgaggccggtgagttcccgccggaagcgctagccagttggaagtcatatagggattacggaatcgagacccatctctttgacgcaacgacggattttgggattccggtgatctttgcgctccagatatcggatcaggatgacgacatcgctcagctcgtaggcgctgcatccgctttggaacccgctgaggcgctgactaaagtattcagggaaatggcatcgatccgaatagcactacgcgcctttctcgcccagtccacatcgattaagatttaccccgatgtggctaacgtgacagggggtgccgccctcatgggccagcgcgcgtaccgagatgcattttccttcctccttaacagcgagcgcgaaacgtcaccgtcgcggatgcctaacctcctagagctgaatgatgatccactgcgcgagatgattattcgaatacgcctggctggcgctgaagttatcgccgtcgatatcacgacggacagagcgaggtcagttggtgcaagagtagtgaaggttttggtcccagaggcggttccactctcctttgttcaccgagagaggtatttagatactcctcggctcatatccgcgcctaatagcatgggatatttggttgacacagcgcctacgttcaaccggaacattcaaccttttgcgtgaaactcatatcaaggaaggccagaccgactaatggaccgcttcgttgtgactcggacgctcttcggcgtggagctcgctaaagaactccagtcctccatcttagaggatgggccatacataggcgactcagttcctcactggaaacaaaatcaattactcgtgtacgtgacgacagatgaggcatccccaaggttggactcaattgacggcggggcgttctcagctggccggccttggctccccgtccgtcttcgacccacagtgattcactgcggccccataatttggccaggtagtacgccttgcttccggtgcagtgtgaaccgaatgaagcagcactctcccatgcctagtctcgtaggttcaggaccggagcttgtggaaggctatgcggcgtttcatgtcagacttatagcggcagcgatctcgttgctggaggagagattctctgagggggagatcttaggtaggggcttatcatttaatcttgtcaacgggtttcttaaccactatcctatcgtgcccgttgatcgctgtccgagatgcggtggccgtttcggtaaacgggaagatgagcaccaagagttgggctgcgtcgcacgggaggtgtgtcaagtatgaagggtataatcagtggtgaacaggtgggaaatgcagctcgctttgacaagcagttcagggtccctcgtcggccgagcaggcggctcggtgtcgatattgagatccgtgaggatgcaacaattctttggggatcagatcgtctgcagacatttacaggaggaatgaaaccttcactgattgaggatattttacgagcgtgcgacggaactaagacggcacgtgagctcgcctctgtatgtgatgttacggagcccttgatggacaagatagtggcccttctctgggtctcgggtgctattgaggaggcgggcccgaccgatgttgaaagttctccgcttggggtccttttgtctcgccttgggaacgcaactggggcgaatgctagctggcaggaagctcagcacagaattaacagcatgccgatctgtgttatgccccattcggaacttggaacggaggttgcgggcgcgcttgctggcacctttgaggttatcaatgaagaggcagcttttgaacgcggcgtggttctattcatctttatcgaaaccgcgtcgtctaagatcgaacagcatcacaaatttgatgaactgacaaagagaagagtgctattggttagcgctgcgggtgacgaagttgtagtggggccgctttatgaccaggctataacgccctgccttcggtgctgttcgtcatcgaggatcaagctggatcggggtgcctcgagcccggcgcagcttcgtctcatggctggaattgtctcgcatcatattgttgcgttggtaagcagggcgttactctcaccgctgcccacggattccttggcgctgaatgtggtcactggtgtccagcgctactctcccccggtgtccagaccgggttgccccgaatgttcgcatgcgatcccagctattgctagtgagccgacggtcggtgccgtgtacgaggcttccgtagcactccctccgcgagaattcgtgaatgtaagggactatcaagcccacttcttgagcgcaaatcaacaacttcaaacgaaatttaagtcatggggaaaaagggaaaaattccctttgcctgacattaatatttcagacctacatatacagattgacgaccttctttttttagctgctgcccttaggtttgggttcggaatagacccggagcggaccacttcaaaaatagcgaagcgctggacggcctctggtggaaacattggctcggtaaacgcattcgtgagccttcctgcgatggtagggcacattcccagtgggatttatggatattcagttagcgatcattccctagccaaagttagtcaggagttgatttcggcgactgacatcatgatcgcggcttctgccgacctacggaagatcgcttctaaatatgggacattcggcttgaggatcgcgattatggacgccgggtgtgccctttcaacggtgcgtcgtgtctgccgggaagtaggccgtacattttcgatgtggagcgctgacctcgacgctgggtctattagcgagatgctgcatctttcaagtgcgcgtgagcctattattggagtttcagtgctgggaaaggggcaacgagggtgaggacagacattcccgtaatgaatgccattctgtgtggaatttctggtttgaggccgagagttgcggagctccggctgaatcatgtaccaggagaacttgaaggtgacctgatcggcgagttctcggggccagttactccggatgaaggatcaccttgtctgccgtgcaagagcttccccgaattcttgcagacaaggaggtcggtatcccattttagagacgaggcggttgacgcacgctgcgtcatccatgcagtggctcaggctcttgaggatgatgagcgactgtgggggtgctcagagaccgctggtcttcttgaggcgtttgtctttgtgcttcgagatagtgttggcggtcctggaccggggatctatcaggtgcggcgcgattctgcggtgagaatgacaactgccgctgaacttggcgatccgattcgattcggtgttcaggaggaattcttcgcagggtcaggggtagttatcttttgcgcgaatctggacgtggaggatggcgccggaggagcaaacggatacttagttaatactctccgagcttccatggcactctacgaagtccatgttgaactcggttgcatggacgtggttggctccgttttcggaggcttcattccagcttcgctgcgatcgctcctgttggcagatatggttactcgtcagcaaatcatctcttgctcctatggttttccagcctaacttgctcgacccgccagtagctgggttgtgaattgggtaatgaatggatcgaaataatttgtaccatctgagtcgcgagaaggtaaatacaaatgaaaatgaggcacttaatctcaatgtgatggagttctcggacatgattagcgacgctactgagcgcgacgacgtcactcagataatggcggcatcttgcgtcgagacgagtgtatcgtcgagttccacgtcatcttcatgatcgccaagtggcagattatggagccaggagaagaggtccgtacagggcgaatactcagacgcgacttagccttcgcagttgtcgtggaagtttatctagccgtcttaggttgtttcagcaaccctacacgggaagatactcttagcgctctggggtgggattatttggttcgccaaagcgattcaaggcttcctctctaggcggttatgattagtgtcgaaaccaattgaggggaggtgaacagaatggagaacgaaacgttggaccttgacgtgatggagctggccgatatcatcggtagtgcttctgatcaagacgacatggctcaggtcatggctgcgtcgtgcaccaccacgagtgtctcgacgagctcttcgtcgtcctcgtaacgagatgggcgggctggcgggtgcttttcgggcccgccggcccgttcctttgttatttacggttctttgcttgagcgggctgaatcgtggtggggaggttgtctaaaatttgggctcgggctcgaggccggccgcgtaaattgaccacaatgagcgtgctgcggtaacttagacgtaagatacgcttctcctgctagccttatttgttacccgtttggatttcacctagatgcacgctagggtaggctgattagcttttatggaaatgatattattattatgataattagtgtagatgggatttggaggggcatcgtgtagctagtctcaaatagaagcgatcccgcagtgcagcgtattttggatatgtccaggccttcgttcaagctggtttgatgtttttaaaggatgtggtgaccgttcacattgcgcatggctgccggtgtgcacattgttgagatgtattcggaggctggaaaggcagcggctttttcaattgacgcgtatgcaaccctgggggttccatatcgagaaatgtcatcattgttgttgtcgtaagtattcaaggtgggtaagcgccctgagattttcgctgttgatcgggtggcgcatgaggctaatgccggcgtaattgatccgaagctagatttggttgttttgaacagtttgcacaccgtcggtaatatgggggcgataatttagacctcctttgtgcttggctcaagggcttttgttctagtggacagaaacttgagctctatttccgataggagggttcttctggcttctcctagatacgtctttcttcttctggttctgagagctagtcgcgatgagcttcttgagttgtgcaccagtcgtcgggaactggtgaaattcttggcggatggctatgtggatatggcctttttctggtcttgagaccatccgatcacgatggtctagggaagcaaggataagggtgtgtcgataatttgattatcggatttccatctccgttagaattctgatgctggcggatgctaagtcattgaatgatgtgtctgtggcggtcggaattggactacatgagaggccgcagcgtgacttggagagcggatcttaggaatcagttcagggccaggactcccatccaggccatcagtttgttggcgaagctgacgatcagctgcccgatccagttctgtgtgaagccttttcaacgacagatcggtcaggctggtgtccttcgctgtcagggtcaggtctaacagccgggcccgtgggacgtcgtcggtgtgcgtgaagacagctatgccggtgagcatcttcggtccccgggttcgtgggttcttgtcgtgccagacgtgctcacccccccaggtgccgcatccccgcaaagcggactgggtcagcgtccgcctcctctaagaccgggttgaccgcccgccagacagtcttccagtcgccctgagcttggcgtgcgagtcccagcactgagacgcgttctcggcgcagctgccccacggcccatcgagtggcacggcgggtcaacaccgcccacagtacggcgatcccaggatcttgttccgtgaaagagcccttgctacacaaggcttcgaggcagcgccacgtgcgtgtacaccacccgatcacgaccgccatactgccgaagaaacatcgtgcaggacccggcggcggccatggggagacgcgagcacaccgcagtcggggcagaacccctcgcccggagctaacttcacccccaccataatcgtatcgggtccgcgctcgacgtcggtcacgtacagaccgggcaggttagggcatcacaacgagggcagtagttggtaggctcacacacagtcggggtcttcttggagcagcgagtttgggcgctgctgatcctgccgaataaccccgacccctcaccgcaccgggccccgactagctgccccacctcaggcccgaagagccagacaactcttgttgagcttcaaagccatgaaatcttcggtctgcttcttaatgccagtctctgccgggaatcgctcgatggaagatgcgccgtagaagcctacgatgccatcggtgtgatcgagaatgtattgcgcatcctcgggattggcgatggggccgccatggcataggcataggatgtcgggattgacggatttggcggcgtcggcgagttcctgaaccttgacagcagcatcctcgatagtgagtgctgtttttgcaccaatggttccggaggttgtcagacccatgtgggggacgaggatgtcagagcccgcccgggccatatccttggcctggtcaacgtcgaaaacatagggtgaggtgaggagatcaagatcgtgggcaattttgatcatgtcgatctccaaaccgtaccccatgccagtttcctcgaggtttgcgcggaatgtgccatcgatgagaccaacagtagggaaattctgcactccggcgaaccccgcggctttgatctgggttaggactggggcatcactctgaagggatcagtgccattaactccggcaagaactggggtgtgcttgacgacgggcagtacctcgcgcgccatgtccatggcgatctcattggcatcgccgtaagcgagaagccctgagagggagccgcgacctgccatccggaaacgtcctgagttatagatgacgagcagatcgataccgccggcttccgcggatttaaccgtaatcccggtgcctgcgccgccgcccaccaaggggattccgttggcgacttgtccgcggaactttttcaggatttcagtgcgggtcatgatgctattcctttccgattagttatggatgatgagctcgtgaagagcccgcgccattgcttcgccaaaaccagaatcattgatattttgttttcgctcagtcacagtgatgtcggtatcctttattccctctcgaatggcgttgaacaaagcgtcatcggcttctggatcatagaaatcttcacctggggtatctattcctgcgacccccagagtaggaatgaaagcttgagccgggccgcgcgcagcggccgcctttatggcgattctgtgaccaagctcggccatttcggtgttgctcgtttgagcgtcaccgctggattgtggatatgcaacgtgcgagaggaatagcgctccggaatagtgtcgacagggccgaaattgaccatgtcaagcgcgccaagactgatgacttcgggtattccaaggtctgctgcggcttccatccggcggggtcctgccgagagaactcctccgcagaggtcgtcggcaagctcggtagtcgtcaggtcacatattcccgcgagtagcccagacgatgcgagcttttctatcgccttcccctcccggaatcagttgcgtggaagacgaggacctcgtacccaaggtctgtcaaggtcttgcgagcttcgtcagcagccggcgttgtcaatccgaacatcgtcaggccgacgaccggtttgttgtgagcggggttgctgacggttctaacgtcttcatactccttggccatggctgtgatagcggcggctgcattggcgaagaccatgagcgacacggaattgatgccggccacgtcaacgacggagtacataagtgtgacgtcggtttgtcccacgtaggggctgacatctccggaagccatcgtggaaaccaggagcttggggaatccaatcggcaatgtctgcatgaccgaagccgctacggatgatccacctgatccgccgagggacaggagaccgtggattttcccctcttcggcaagcttggatgcaataatcgaagcgccacggcccatgacatccatcatttcgccacggttatgacgtgttcggatgtcacttggcgactcgcctgcggcacgaatgacctcatcggacgtgtagtcggctatacggctgttggagaatgagccaacatcgatgatgactacctggctgccgttggtaagaatgcggtgacgaagccagtcgaactcgtctcccttggtatccaaagttccgagcaaagctattgcggccatgaacactccttcgtgatcgtgtcatcatgaccgtagttcggtgattctgcctacaccatgccgtttgagacgaattggcctgtacgttgtatcgctggttgtgaagaagggcaatacttcaggtgtggttgtcaaggttgaccctgcaagtctgagccggatgctgggggagtggagccagcccggagaagcgcttccggaagcgttggcggacgcattgctggatctcattgacgctggttttgtgcccgctggtgcggttcttccaccccaacgagcatgcgccgcgacactgcaagtatctcggcaaaccgtggcggaggcatttgggattcttgaagccgcaggccacattgcggcgttggttgggtcagggacgcgggttagatcaggccgcgctgcagtgagtactgatggcaggttgttctcgttcagcgaggctgcacctggcctgatcgacctgtcaacgggggcgctacctgcgtcagaggtggtgcgaagagtgcggctagaagaccacgtcgacttggatgagtatttcgataccgacggatatttcccggctggactacctatattgcgtgcagccatcgcggaacggctcactcgagatggagttcccacagtcccgcagcagatcgttgttaccaacggcgctcagcatgcgagttatcttgcctctcagctcctggtctcggctggtgacaccgtgttggtggaggagccgacatatcggggtgagctcgcagagctgcgactgatgggcgcccgtgtgaagagtgtccc

SEQ ID NO: 57 - DNA, 12237 bp, Propionibacterium acnes
gttgtctggctcttcgggcctgaggtggggcagctagtcggggcccggtgcggtgaggggtcggggttattcggcaggatcagcagcgcccaaactcgctgctccaagaagaccccgactgtgtgtgagcctaccaactactgccctcgttgtgatgccctaacctgcccggtctgtacgtgaccgacgtcgagcgcggacccgatacgattatggtgggggtgaagttagctccgggcgaggggttctgccccgactgcggtgtgctcgcgtctccccatggccgccgccgggtcctgcacgatgtttcttcggcagtatggcggtcgtgatcgggtggtgtacacgcacgtggcgctgcctcgaagccttgtgtagcaagggctctttcacggaacaagatcctgggatcgccgtactgtgggcggtgttgacccgccgtgccactcgatgggccgtggggcagctgcgccgagaacgcgtctcagtgctgggactcgcacgccaagctcagggcgactggaaaactgtctggcgggcggtcaacccggtcttagaggaggcggacgctgacccagtccgctttgcggggatgcggcacctgggggggtgagcacgtctggcacgacaagaacccacgaacccggggaccgaagatgctcaccggcatagctgtcttcacgcacaccgacgacgtcccacgggcccggctgttagacctgaccctgggccgctccggaaccgtgtatggcgtctggctccagtaacgcggccaagcggtggcagcaggtcgagatcaccgcgttggacccgtttcgcgattacaagcacgctatcgatgatcacctcgataacgccacagccgtactgagtcccttccacgtcgtgaaacttgccgcccaggccctcgacgaggcccgacgccgggtccaacaagccccctcaggcaaccgcggccggactagcgacccgctctacggcattcagacgatcctgcgagccggggccgagaacctgtccgacaagcaaaaacaccgtcttgccaccgtgatcgacgctaacgaggcacacgagaaaatgttcattacctggcacaagcagcgtaacggctccgggccgtcaacagaccgatcgaactctaccgccgcatcgcccgtggctccagcaactgcgacaactaccgcctactccgctgctcatcgccgggggcaacacacacgaaccaccgccaagtcagacgagccatttatagcccaacagctatttgggtgatctcctcagcctgacagcgccagacgtcggtccgccatgctaagctgaacgcgtcgcttaagcttcgggaatagaaatgggaaacggtatgactcaaatacttattcaaatactcccggaatagacattcttgcggcgcgctccgctctaatcatttcgtggccgcctctcctacgacgaattgtgcattagggaagtacagtgcatctcagtccatatgtagtctttcgcaggacacgactcgcctactctcaacttcagagcagctccttcgacgcactctggcagcaagtgcaagaaatggtcgataagcatgcgcaattagaggttcagaccagcaggcttacggcacacctggagtctgttatttcagtaactgcgcctcgtgacagatctcgactaatcacattaaaacgtgacgtgcataacatgcgcgtggaaaaagtgaagcaaagactactgcactgtcagggctgcacggctagcaacattatggagcctgtatctagttggatcgatacatgtcgatcatacgaaatacttgagcgtcggttgagtcaagtatatgcggacagccgagacgaagtgtctcgtcactacaggtccctctaccaggctgacgcaatagagccaagcattcaactctcaggtggccagctccacagtgacctgacgcgtctgattagccacggttctaggataaaacccactaaagagcggactctggaaacgactcttgtaaactatctctacagggcagcaacaaagccatcacctttcggtcgtttcgtggaagtaggggccttcgacccgtctcaaccaaattccgaacctcgacgctgcagtgaatccagcgtgacgacaaaccggattcttaccagctggctcactgcagtaacagcgcgttctttcgccgcaccagaaatgcttgctatcctcaacagcaccctgcgcgttaaacgcgatataatccagttcattggaattccacctggggagtggcgaggtgcaccgagcattcccgaggagcgcctgctaactatccgcaagcgcgaagatatgatgtctgttcttaagctcctaatgggcggcccaagatcagtcggtgacctcattattgcccttaatgaccaaggcatagatgaatcacacgcaactaatcttctcagcagtttgagtacagcagggataatcttctttcggctcccagtagatgaccatgacgtacactatgtacagactgcgtgtacagcgctaaggttaaccaaagatgagtcacttcgtgccgctttccaaagtctggcgaacgctgaaaaggagttccccacagcgtcagtcgccacgcgtcacgaccttctcctcagcatcaaggattccgtgaatactgtcgcgtcggcacatgatgtgccggccccaccggacagcgtactcaagagccctttgtatgaggacctccccgccaccgcggcaccccagacatgggattcgaacacggttgagagatcagcccgcgcactcaggagcatctggctactgagcgatttaatggatagctctcaacgccgacagttgggcctctcccagttcatagcagacatgaataatggcgcgccagttacttttctggatttcttcgactcgttttcgcgccttagcattcgtgagcgccaaggaatcctgcgcggagaaaactcaccgcaaatcgcccgtttcgctcagcaatatagtgaagcattgcttaaaattcgcgatgccgttaactacacgcaggacgaagcccaccttgaatctcaggtaattctcgatgcgatcaccaatattgatgatttccgaccgactaagtcggtcacaattcgaggacaattcacaacatcgctcacctcccatataagccaactgataatcaacggtgttatgacgggatacggtacatacatgtcccgattcgcaacatttgtaaacccatcaggtacttggagtctagtcgacgggattcggagacatctatccgatcattttccaggtcaatgtgatttgaattccgtactgggattcaacttcaatgttcatccgcaaatgacagcacatagtatcgcctatcctggagtagttcctgtgcttaatggtgccaagacacattcgattcaggatttaatactgattccaactgctgaagcaggtccgcgccgcgtcgctatctttgatagagcagagaacgaacttatcgacctccagcccatgaatttcatggttccttttggggtgcctttgctgtatcggactctagagttcctgtgcccatcgaccagatacctatggaacccagctcaagaccttctggatatcccaatgatagagaacagttgccctcggatttactttgacgacgtagtggctcaacgccgttcctggacgtgcagcgccgagacgctcccgtgtcccccagagaaactctttaggggtgatcttgctgctttgcaagccttcgactcgtggagactatcagcgagggtacccagacatgtctttgccctagtacaaacggctacggaaagacaaattttttccggagcggccgacgcgccaaccttgctctccgaatacaagcatcttcggagagcaagtgtgcataagccaatctacctggatctacgaaacccacttctagtccgttctctcgcgaaggtgatcatgtccaggcccgaactatatgtcacgttttccgagttcctcccatcggaggccgattacacgcagaacggaagctgccccagttacgcagaggagtacttcattgaactgtgtgccgagtgacagcgcaagcatgtctgatcctggcggctggcgggcgctccatattcacttgcctccctcggtgcagtccgagtacctagctgacgtgattcttccctcgatgtcagccttgatgccagaacatgactacttcttcctccgatattggcaggggggatcacatctccggcttcggctccgtagcactcccgagcgccccctagatgatgaggctatcaacgaggttgcatgccatctccgtagccttctcccggcgttgtcagaccaaaagcgcgcggagtaccgctattcgcaatcgcttcaggatcagttagccgaaatggaaagggctgattgccttcccctagaggcggttgggaccgtggtagagcgccggtaccagcctgaatatagaaagtatggcggatcggtcggagtatccattgcagaggatgttttctgtagtactagccgatctgtccttcgcattctaagtgagcgaccaactagccaccgacagcccttggggtatgcttgccaagttttcatccagatgctgggctgcttagggctcgcaacttcgcaggttgaccagttcctcaccagatatgcgcagtggtggaccccttactcaatggccgctcgccctgagatcttagcggcgcgtctctacgccaacttgtcaagcgtggtggcggacctatgggccgcaagtgagcccaacggaatgttctcggttccggctctcaatgcttatacccaatggtcacggcgacggtcgtccgcgagaaataccagcgtaaagatagacccaatgtttctatcttgcttagcgaactacattcacacaaccaataaccgacttgggctcccacccgccctagaatcgacagcggcatatcttgtccaacttggattccgatcggtggctgtcaggggggagaaagtgcgatgaatccaaaaaactccaaagtgacggaactttggtttccagataattcagactcgccatgtactcttcttctcgacttatctcgggcctccgctgagggcactgagcctagtcctcaatactactgtcgaacttgggacccaacaacaaaagatcccggagtaagggttggcatacttgatcccaaccgcttaactcatcaaacggctttccttggcggttccggtattacgcatcacttcttggtaatggaaaaaccacccagctggcctcttctatggaacgcgggtttcgcgggcttgaagctttccacgataagcaaacaattgttcaccgcgtcatatccatggatggtaaagtgggcgctacaggcatcggcttggacggacgacgaacgccttctggctcttacgaaacttctagttgcccacgctgatgcaagccttccaccggtcgataagactgaaatgctcggccgcctccctttgaagttgagcttgcgactgatcacatatcgttcccactacgaaagcatccgcgctcgcacgattgacccgaaagcgatggatactgcggttaatcgggccttcatgaagtatcaagacgagctcctgcgatggtcccagtcgttgacatgctcgtcgagctatcgtgagaaagaatggagtaatcccaacctttcagaatggagcgccatcatttattgccatctcccacaaattaggcaactcctcagcgggggaggattaactgtcgcgggcccgacacgcgaggatatagaagcctccttaggtcacagtattcctgatacacgatttcacgagcgtcttgaccccgccatgcagtattatctcaatcatgaccaagacttcacggcatacagattctgcacgggttttttgtacagcaacctgtactcgctaggaataccgttgaggctgcgctaccttgtctgtgggttggcagcacgtttcaacgaggagctgtcggacacgacttggcgcgatttacgggatctcttccacgaggctgctactgttgcatattacacacgcgacacagacgggagcgggattagataatgacagttgagcgtcagcctctgcgggagcgtgcaaggagcctcgtttcaccatacggactagtttcccaagtacaccctctgcacgccaatgaagcagatccaccgtttcatgtgcatttgggtcgaacaggccactcaatacacgaggggcaaattacttttgagggagatatcggaaacaccgacggggcagggtcgggatccgacagtaccacggcagaatttattgcagtaatggagtccttagagcgctactccagcgcaatgtgggacgctcgttcctttttgctggaatcggaaaataatctgcaggagcgacttgtatctcccaaccaattcccacgctgttctacagccgagctagattctggacatgtactcaggcggtacgacccgggcgtcccaatacgatgggtcagaggatggtcactgacttcaggtcatcaggtgtgggttccggcgatcgcggtttatctgcatctgccgtacttaaacgactctgaacgattcatacgttcagtctcgaccggatgtgcggttcatgaatccatgcggaaggctgttcttaacggtcttttagaagtcgtcgagcgagatgctattgctttgacttggttgcatgagttgcccttgcccagaatcgcggctagcgaggccggtgagttcccgccggaagcgctagccagttggaagtcatatagggattacggaatcgagacccatctctttgacgcaacgacggattttgggattccggtgatctttgcgctccagatatcggatcaggatgacgacatcgctcagctcgtaggcgctgcatccgctttggaacccgctgaggcgctgactaaagtattcagggaaatggcatcgatccgaatagcactacgcgcctttctcgcccagtccacatcgattaagatttaccccgatgtggctaacgtgacagggggtgccgccctcatgggccagcgcgcgtaccgagatgcattttccttcctcattaacagcgagcgcgaaacgtcaccgtcgcggatgcctaacctcctagagctgaatgatgatccactgcgcgagatgattattcgaatacgcctggctggcgctgaagttatcgccgtcgatatcacgacggacgaagcgaggtcagttggtgcaagagtagtgaaggttttggtcccagaggcggttccactctcctttgttcaccgagagaggtatttagatactcctcggctcatatccgcgcctaatagcatgggatatttggttgacacagcgcctacgttcaaccggaacattcaaccttttgcgtgaaactcatatcaaggaaggccagaccgactaatggaccgcttcgttgtgactcggacgctcttcggcgtggagctcgctaaagaactccagtcctccatcttagaggatgggccatacataggcgactcagttcctcactggaaacaaaatcaattactcgtgtacgtgacgacagatgaggcatccccaaggttggactcaattgacggcggggcgttctcagctggccggccttggctccccgtccgtcttcgacccacagtgattcactgcggccccataatttggccaggtagtacgccttgcttccggtgcagtgtgaaccgaatgaagcagcactctcccatgcctagtctcgtaggttcaggaccggagcttgtggaaggctatgcggcgtttcatgtcagacttatagcggcagcgatctcgttgctggaggagagattctctgagggggagatcttaggtaggggcttatcatttaatcttgtcaacgggtttcttaaccactatcctatcgtgcccgttgatcgctgtccgagatgcggtggccgtttcggtaaacgggaagatgagcaccaagagttgggctgcgtcgcacgggaggtgtgtcaagtatgaagggtataatcagtggtgaacaggtgggaaatgcagctcgctttgacaagcagttcagggtccctcgtcggccgagcaggcggctcggtgtcgatattgagatccgtgaggatgcaacaattctttggggatcagatcgtctgcagacatttacaggaggaatgaaaccttcactgattgaggatattttacgagcgtgcgacggaactaagacggcacgtgagctcgcctctgtatgtgatgttacggagcccttgatggacaagatagtggcccttctctgggtctcgggtgctattgaggaggcgggcccgaccgatgttgaaagttctccgcttggggtccttttgtctcgccttgggaacgcaactggggcgaatgctagctggcaggaagctcagcacagaattaacagcatgccgatctgtgttatgccccattcggaacttggaacggaggttgcgggcgcgcttgctggcacctttgaggttatcaatgaagaggcagcttttgaacgcggcgtggttctattcatctttatcgaaaccgcgtcgtctaagatcgaacagcatcacaaatttgatgaactgacaaagagaagagtgctattggttagcgctgcgggtgacgaagttgtagtggggccgctttatgaccaggctataacgccctgccttcggtgctgttcgtcatcgaggatcaagctggatcggggtgcctcgagcccggcgcagcttcgtctcatggctggaattgtctcgcatcatattgttgcgttggtaagcagggcgttactctcaccgctgcccacggattccttggcgctgaatgtggtcactggtgtccagcgctactctcccccggtgtccagaccgggttgccccgaatgttcgcatgcgatcccagctattgctagtgagccgacggtcggtgccgtgtacgaggcttccgtagcactccctccgcgagaattcgtgaatgtaagggactatcaagcccacttcttgagcgcaaatcaacaacttcaaacgaaatttaagtcatggggaaaaagggaaaaattccctttgcctgacattaatatttcagacctacatatacagattgacgaccttctttttttagctgctgcccttaggtttgggttcggaatagacccggagcggaccacttcaaaaatagcgaagcgctggacggcctctggtggaaacattggctcggtaaacgcattcgtgagccttcctgcgatggtagggcacattcccagtgggatttatggatattcagttagcgatcattccctagccaaagttagtcaggagttgatttcggcgactgacatcatgatcgcggcttctgccgacctacggaagatcgcttctaaatatgggacattcggcttgaggatcgcgattatggacgccgggtgtgccctttcaacggtgcgtcgtgtctgccgggaagtaggccgtacattttcgatgtggagcgctgacctcgacgctgggtctattagcgagatgctgcatctttcaagtgcgcgtgagcctattattggagtttcagtgctgggaaaggggcaacgagggtgaggacagacattcccgtaatgaatgccattctgtgtggaatttctggtttgaggccgagagttgcggagctccggctgaatcatgtaccaggagaacttgaaggtgacctgatcggcgagttctcggggccagttactccggatgaaggatcaccttgtctgccgtgcaagagcttccccgaattcttgcagacaaggaggtcggtatcccattttagagacgaggcggttgacgcacgctgcgtcatccatgcagtggctcaggctcttgaggatgatgagcgactgtgggggtgctcagagaccgctggtcttcttgaggcgtttgtctttgtgcttcgagatagtgttggcggtcctggaccggggatctatcaggtgcggcgcgattctgcggtgagaatgacaactgccgctgaacttggcgatccgattcgattcggtgttcaggaggaattcttcgcagggtcaggggtagttatcttttgcgcgaatctggacgtggaggatggcgccggaggagcaaacggatacttagttaatactctccgagcttccatggcactctacgaagtccatgttgaactcggttgcatggacgtggttggctccgttttcggaggcttcattccagcttcgctgcgatcgctcctgttggcagatatggttactcgtcagcaaatcatctcttgctcctatggttttccagcctaacttgctcgacccgccagtagctgggttgtgaattgggtaatgaatggatcgaaataatttgtaccatctgagtcgcgagaaggtaaatacaaatgaaaatgaggcacttaatctcaatgtgatggagttctcggacatgattagcgacgctactgagcgcgacgacgtcactcagataatggcggcatcttgcgtcgagacgagtgtatcgtcgagttccacgtcatcttcatgatcgccaagtggcagattatggagccaggagaagaggtccgtacagggcgaatactcagacgcgacttagccttcgcagttgtcgtggaagtttatctagccgtcttaggttgtttcagcaaccctacacgggaagatactcttagcgctctggggtgggattatttggttcgccaaagcgattcaaggcttcctctctaggcggttatgattagtgtcgaaaccaattgaggggaggtgaacagaatggagaacgaaacgttggaccttgacgtgatggagctggccgatatcatcggtagtgcttctgatcaagacgacatggctcaggtcatggctgcgtcgtgcaccaccacgagtgtctcgacgagctcttcgtcgtcctcgtaacgagatgggcgggctggcgggtgcttttcgggcccgccggcccgttcctttgttatttacggttctttgcttgagcgggctgaatcgtggtggggaggttgtctaaaatttgggctcgggctcgaggccggccgcgtaaattgaccacaatgagcgtgctgcggtaacttagacgtaagatacgcttctcctgctagccttatttgttacccgtttggatttcacctagatgcacgctagggtaggctgattagcttttatggaaatgatattattattatgataattagtgtagatgggatttggaggggcatcgtgtagctagtctcaaatagaagcgatcccgcagtgcagcgtattttggatatgtccaggccttcgttcaagctggtttgatgtttttaaaggatgtggtgaccgttcacattgcgcatggctgccggtgtgcacattgttgagatgtattcggaggctggaaaggcagcggctttttcaattgacgcgtatgcaaccctgggggttccatatcgagaaatgtcatcattgttgttgtcgtaagtattcaaggtgggtaagcgccctgagattttcgctgttgatcgggtggcgcatgaggctaatgccggcgtaattgatccgaagctagatttggttgttttgaacagtttgcacaccgtcggtaatatgggggcgataatttagacctcctttgtgcttggctcaagggcttttgttctagtggacagaaacttgagctctatttccgataggagggttcttctggcttctcctagatacgtctttcttcttctggttctgagagctagtcgcgatgagcttcttgagttgtgcaccagtcgtcgggaactggtgaaattcttggcggatggctatgtggatatggcctttttctggtcttgagaccatccgatcacgatggtctagggaagcaaggataagggtgtgtcgataatttgattatcggatttccatctccgttagaattctgatgctggcggatgctaagtcattgaatgatgtgtctgtggcggtcggaattggactacatgagaggccgcagcgtgacttggagagcggatcttaggaatcagttcagggccaggactcccatccaggccatcagtttgttggcgaagctgacgatcagctgcccgatccagttctgtgtgaagccttttcaacgacagatcggtcaggctggtgtccttcgctgtcagggtcaggtctaacagccgggcccgtgggacg

SEQ ID NO: 58 - DNA, 3582 bp, Propionibacterium acnes
cagggtcaggtctaacagccgggcccgtgggacgtcgtcggtgtgcgtgaagacagctatgccggtgagcatcttcggtccccgggttcgtgggttcttgtcgtgccagacgtgctcacccccccaggtgccgcatccccgcaaagcggactgggtcagcgtccgcctcctctaagaccgggttgaccgcccgccagacagttttccagtcgccctgagcttggcgtgcgagtcccagcactgagacgcgttctcggcgcagctgccccacggcccatcgagtggcacggcgggtcaacaccgcccacagtacggcgatcccaggatcttgttccgtgaaagagcccttgctacacaaggcttcgaggcagcgccacgtgcgtgtacaccacccgatcacgaccgccatactgccgaagaaacatcgtgcaggacccggcggcggccatggggagacgcgagcacaccgcagtcggggcagaacccctcgcccggagctaacttcacccccaccataatcgtatcgggtccgcgctcgacgtcggtcacgtacagaccgggcaggttagggcatcacaacgagggcagtagttggtaggctcacacacagtcggggtcttcttggagcagcgagtttgggcgctgctgatcctgccgaataaccccgacccctcaccgcaccgggccccgactagctgccccacctcaggcccgaagagccagacaactcttgttgagcttcaaagccatgaaatcttcggtctgcttcttaatgccagtctctgccgggaatcgctcgatggaagatgcgccgtagaagcctacgatgccatcggtgtgatcgagaatgtattgcgcatcctcgggattggcgatggggccgccatggcataggcataggatgtcgggattgacggatttggcggcgtcggcgagttcctgaaccttgacagcagcatcctcgatagtgagtgctgtttttgcaccaatggttccggaggttgtcagacccatgtgggggacgaggatgtcagagcccgcccgggccatatccttggcctggtcaacgtcgaaaacatagggtgaggtgaggagatcaagatcgtgggcaattttgatcatgtcgatctccaaaccgtaccccatgccagtttcctcgaggtttgcgcggaatgtgccatcgatgagaccaacagtagggaaattctgcactccggcgaaccccgcggctttgatctgggttaggactggggcatcactctgaagggatcagtgccattaactccggcaagaactggggtgtgcttgacgacgggcagtacctcgcgcgccatgtccatggcgatctcattggcatcgccgtaagcgagaagccctgagagggagccgcgacctgccatccggaaacgtcctgagttatagatgacgagcagatcgataccgccggcttccgcggatttaaccgtaatcccggtgcctgcgccgccgcccaccaaggggattccgttggcgacttgtccgcggaactttttcaggatttcagtgcgggtcatgatgctattcctttccgattagttatggatgatgagctcgtgaagagcccgcgccattgcttcgccaaaaccagaatcattgatattttgttttcgctcagtcacagtgatgtcggtatcctttattccctctcgaatggcgttgaacaaagcgtcatcggcttctggatcatagaaatcttcacctggggtatctattcctgcgacccccagagtaggaatgaaagcttgagccgggccgcgcgcagcggccgcctttatggcgattctgtgaccaagctcggccatttcggtgttgctcgtttgagcgtcaccgctggattgtggatatgcaacgtgcgagaggaatagcgctccggaatagtgtcgacagggccgaaattgaccatgtcaagcgcgccaagactgatgacttcgggtattccaaggtctgctgcggcttccatccggcggggtcctgccgagagaactcctccgcagaggtcgtcggcaagctcggtagtcgtcaggtcacatattcccgcgagtagcccagacgatgcgagcttttctatcgccttcccctcccggaatcagttgcgtggaagacgaggacctcgtacccaaggtctgtcaaggtcttgcgagcttcgtcagcagccggcgttgtcaatccgaacatcgtcaggccgacgaccggtttgttgtgagcggggttgctgacggttctaacgtcttcatactccttggccatggctgtgatagcggcggctgcattggcgaagaccatgagcgacacggaattgatgccggccacgtcaacgacggagtacataagtgtgacgtcggtttgtcccacgtaggggctgacatctccggaagccatcgtggaaaccaggagcttggggaatccaatcggcaatgtctgcatgaccgaagccgctacggatgatccacctgatccgccgagggacaggagaccgtggattttcccctcttcggcaagcttggatgcaataatcgaagcgccacggcccatgacatccatcatttcgccacggttatgacgtgttcggatgtcacttggcgactcgcctgcggcacgaatgacctcatcggacgtgtagtcggctatacggctgttggagaatgagccaacatcgatgatgactacctgactgccgttggtaagaatgcggtgacgaagccagtcgaactcgtctcccttggtatccaaagttccgagcaaagctattgcggccatgaacactccttcgtgatcgtgtcatcatgaccgtagttcggtgattctgcctacaccatgccgtttgagacgaattggcctgtacgttgtatcgctggttgtgaagaagggcaatacttcaggtgtggttgtcaaggttgaccctgcaagtctgagccggatgctgggggagtggagccagcccggagaagcgcttccggaagcgttggcggacgcattgctggatctcattgacgctggttttgtgcccgctggtgcggttcttccaccccaacgagcatgcgccgcgacactgcaagtatctcggcaaaccgtggcggaggcatttgggattcttgaagccgcaggccacattgcggcgttggttgggtcagggacgcgggttagatcaggccgcgctgcagtgagtactgatggcaggttgttctcgttcagcgaggctgcacctggcctgatcgacctgtcaacgggggcgctacctgcgtcagaggtggtgcgaagagtgcggctagaagaccacgtcgacttggatgagtatttcgataccgacggatatttcccggctggactacctatattgcgtgcagccatcgcggaacggctcactcgagatggagttcccacagtcccgcagcagatcgttgttaccaacggcgctcagcatgcgagttatcttgcctctcagctcctggtctcggctggtgacaccgtgttggtggaggagccgacatatcggggtgagctcgcagagctgcgactgatgggcgcccgtgtgaagagtgtccc

SEQ ID NO: 59 - DNA, 11477 bp, Propionibacterium acnes
gggccgctccggaaccgtgtatggcgtctggctccagtaacgcggccaagcggtggcagcaggtcgagatcaccgcgttggacccgtttcgcgattacaagcacgctatcgatgatcacctcgataacgccacagccgtactgagtcccttccacgtcgtgaaacttgccgcccaggccctcgacgaggcccgacgccgggtccaacaagccccctcaggcaaccgcggccggactagcgacccgctctacggcattcagacgatcctgcgagccggggccgagaacctgtccgacaagcaaaaacaccgtcttgccaccgtgatcgacgctaacgaggcacacgagaaaatgttcattacctggcacaagcagcgtaacggctccgggccgtcaacagaccgatcgaactctaccgccgcatcgcccgtggctccagcaactgcgacaactaccgcctactccgctgctcatcgccgggggcaacacacacgaaccaccgccaagtcagacgagccatttatagcccaacagctatttgggtgatctcctcagtctgacagcgccagacgtcggtccgccatgctaagctgagcgcgtcgcttaagcttcgggaatagaaatgggaaacggtatgactcaaatacttattcaaatactcccggaatagacattcttgcggcgcgctccgctctaatcatttcgtggccgcctctcctacgacgaattgtgcattagggaagtacagtgcatctcagtccatatgtagtctttcgcaggacacgactcgcctactctcaacttcagagcagctccttcgacgcactctggcagcaagtgcaagaaatggtcgataagcatgcgcaattagaggttcagaccagcaggcttacggcacacctggagtctgttatttcagtaactgcgcctcgtgacagatctcgactaatcacattaaaacgtgacgtgcataacatgcgcgtggaaaaagtgaagcaaagactactgcactgtcagggctgcacggctagcaacattatggagcctgtatctagttggatcgatacatgtcgatcatacgaaatacttgagcgtcggttgagtcaagtatatgcggacagccgagacgaagtgtctcgtcactacaggtccctctaccaggctgacgcaatagagccaagcattcaactctcaggtggccagctccacagtgacctgacgcgtctgattagccacggttctaggataaaacccactaaagagcggactctggaaacgactcttgtaaactatctctacagggcagcaacaaagccatcacctttcggtcgtttcgtggaagtaggggccttcgacccgtctcaaccaaattccgaacctcgacgctgcagtgaatccagcgtgacgacaaaccggattcttaccagctggctcactgcagtaacagcgcgttctttcgccgcaccagaaatgcttgctatcctcaacagcaccctgcgcgttaaacgcgatataatccagttcattggaattccacctggggagtggcgaggtgcaccgagcattcccgaggagcgcctgctaactatccgcaagcgcgaagatatgatgtctgttcttaagctcctaatgggcggcccaagatcagtcggtgacctcattattgcccttaatgaccaaggcatagatgaatcacacgcaactaatcttctcagcagtttgagtacagcagggataatcttctttcggctcccagtagatgaccatgacgtacactatgtacagactgcgtgtacagcgctaaggttaaccaaagatgagtcacttcgtgccgctttccaaagtctggcgaacgctgaaaaggagttccccacagcgtcagtcgccacgcgtcacgaccttctcctcagcatcaaggattccgtgaatactgtcgcgtcggcacatgatgtgccggccccaccggacagcgtactcaagagccctttgtatgaggacctccccgccaccgcggcaccccagacatgggattcgaacacggttgagagatcagcccgcgcactcaggagcatctggctactgagcgatttaatggatagctttcaacgccgacagttgggcctctcccagttcatagcagacatgaataatggcgcgccagttacttttctggatttcttcgactcgttttcgcgccttagcattcgtgagcgccaaggaatcctgcgcggagaaaactcaccgcaaatcgcccgtttcgctcagcaatatagtgaagcattgcttaaaattcgcgatgccgttaactacacgcaggacgaagcccaccttgaatctcaggtaattctcgatgcgatcaccaatattgatgatttccgaccgactaagtcggtcacaattcgaggacaattcacaacatcgctcacctcccatataagccaactgataatcaacggtgttatgacgggatacggtacatacatgtcccgattcgcaacatttgtaaacccatcaggtacttggagtctagtcgacgggattcggagacatctatccgatcattttccaggtcaatgtgatttgaattccgtactgggattcaacttcaatgttcatccgcaaatgacagcacatagtatcgcctatcctggagtagtttctgtgcttaatggtgccaagacacattcgattcaggatttaatactgattccaactgctgaagcaggtccgcgccgcgtcgctatctttgatagagcagagaacgaacttatcgacctccagcccatgaatttcatggttccttttggggtgcctttgctgtatcggactctagagttcctgtgcccatcgaccagatacctatggaacccagctcaagaccttctggatatcccaatgatagagaacagttgccctcggatttactttgacgacgtagtggctcaacgccgttcctggacgtgcagcgccgagacgctcccgtgtcccccagagaaactctttaggggtgatcttgctgctttgcaagccttcgactcgtggagactatcagcgagggtacccagacatgtctttgccctagtacaaacggctacggaaagacaaattttttccggagcggccgacgcgccaaccttgctctccgaatacaagcatcttcggagagcaagtgtgcataagccaatctacctggatctacgaaacccacttctagtccgttctctcgcgaaggtgatcatgtccaggcccgaactatatgtcacgttttccgagttcctcccatcggaggccgattacacgcagaacggaagctgccccagttacgcagaggagtacttcattgaactgtgtgccgagtgacagcgcaagcatgtctgatcctggcggctggcgggcgctccatattcacttgcctccctcggtgcagtccgagtacctagctgacgtgattcttccctcgatgtcagccttgatgccagaacatgactacttcttcctccgatattggcaggggggatcacatctccggcttcggctccgtagcactcccgagcgccccctagatgatgaggctatcaacgaggttgcatgccatctccgtagccttctcccggcgttgtcagaccaaaagcgcgcggagtaccgctattcgcaatcgcttcaggatcagttagccgaaatggaaagggctgattgccttcccctagaggcggttgggaccgtggtagagcgccggtaccagcctgaatatagaaagtatggcggatcggtcggagtatccattgcagaggatgttttctgtagtactagccgatctgtccttcgcattctgagtgagcgaccaactagccaccgacagcccttggggtacgcttgccaggttttcatccagatgctgggctgcttagggctcgcaacttcgcaggttgaccagttcctcaccagatatgcgcagtggtggaccccttactcaatggccgctcgccctgagatcttagcggcgcgtctctacgccaacttgtcaagcgtggtggcggacctatgggccgcaagtgagcccaacggaatgttctcggttccggctctcaatgcttatacccaatggtcacggcgacggtcgtccgcgagaaataccagcgtaaagatagacccaatgtttctatcttgcttagcgaactacattcacacaaccaataaccgacttgggctcccacccgccctagaatcgacagcggcatatcttgtccaacttggattccgatcggtggctgtcaggggggagaaagtgcgatgaatccaaaaaactccaaagtgacggaactttggtttccagataattcagactcgccatgtactcttcttctcgacttatctcgggcctccgctgagggcactgagcctagtcctcaatactactgtcgaacttgggacccaacaacaaaagatcccggagtaagggttggcatacttgatcccaaccgcttaactcatcaaacggctttccttggcggttccggtattacgcatcacttcttggtaatggaaaaaccacccagctggcctcttctatggaacgcgggtttcgcgggcttgaagctttccacgataagcaaacaattgttcaccgcgtcatatccatggatggtaaagtgggcgctacaggcatcggcttggacggacgacgaacgccttctggctcttacgaaacttctagttgcccacgctgatgcaagccttccaccggtcgataagactgaaatgctcggccgcctccctttgaagttgagcttgcgactgatcacatatcgttcccactacgaaagcatccgcgctcgcacgattgacccgaaagcgatggatactgcggttaatcgggccttcatgaagtatcaagacgagctcctgcgatggtcccagtcgttgacatgctcgtcgagctatcgtgagaaagaatggagtaatcccaacctttcagaatggagcgccatcatttattgccatctcccacaaattaggcaactcctcagcgggggaggattaactgtcgcgggcccgacacgcgaggatatagaagcctccttaggtcacagtattcctgatacacgatttcacgagcgtcttgaccccgccatgcagtattatctcaatcatgaccaagacttcacggcatacagattctgcacgggttttttgtacagcaacctgtactcgctaggaataccgttgaggctgcgctaccttgtctgtgggttggcagcacgtttcaacgaggagctgtcggacacgacttggcgcgatttacgggatctcttccacgaggctgctactgttgcatattacacacgcgacacagacgggagcgggattagataatgacagttgagcgtcagcctctgcgggagcgtgcaaggagcctcgtttcaccatacggactagtttcccaagtacaccctctgcacgccaatgaagcagatccaccgtttcatgtgcatttgggtcgaacaggccactcaatacacgaggggcaaattacttttgagggagatatcggaaacaccgacggggcagggtcgggatccgacagtaccacggcagaatttattgcagtaatggagtccttagagcgctactccagcgcaatgtgggacgctcgttcctttttgctggaatcggaaaataatctgcaggagcgacttgtatctcccaaccaattcccacgctgttctacagccgagctagattctggacatgtactcaggcggtacgacccgggcgtcccaatacgatgggtcagaggatggtcactgacttcaggtcatcaggtgtgggttccggcgatcgcggtttatctgcatctgccgtacttaaacgactctgaacgattcatacgttcagtctcgaccggatgtgcggttcatgaatccatgcggaaggctgttcttaacggtcttttagaagtcgtcgagcgagatgctattgctttgacttggttgcatgagttgcccttgcccagaatcgcggctagcgaggccggtgagttcccgccggaagcgctagccagttggaagtcatatagggattacggaatcgagacccatctctttgacgcaacgacggattttgggattccggtgatctttgcgctccagatatcggatcaggatgacgacatcgctcagctcgtaggagctgcatccgctttggaacccgctgaggcgctgactaaagtattcagggaaatggcatcgatccgaatagcactacgcgcctttctcgcccagtccacatcgattaagatttaccccgatgtggctaacgtgacagggggtgccgccctcatgggccagcgcgcgtaccgagatgcattttccttcctccttaacagcgagcgcgaaacgtcaccgtcgcggatgcctaacctcctagagctgaatgatgatccactgcgcgagatgattattcgaatacgcctggctggcgctgaagttatcgccgtcgatatcacgacggacgaagcgaggtcagttggtgcaagagtagtgaaggttttggtcccagaggcggttccactctcctttgttcaccgagagaggtatttagatactcctcggctcatatccgcgcctaatagcatgggatatttggttgacacagcgcctacgttcaaccggaacattcaaccttttgcgtgaaactcatatcaaggaaggccagaccgactaatggaccgcttcgttgtgactcggacgctcttcggcgtggagctcgctaaagaactccagtcctccatcttagaggatgggccatacataggcgactcagttcctcactggaaacaaaatcaattactcgtgtacgtgacgacagatgaggcatccccaaggttggactcaattgacggcggggcgttctcagctggccggccttggctccccgtccgtcttcgacccacagtgattcactgcggccccataatttggccaggtagtacgccttgcttccggtgcagtgtgaaccgaatgaagcagcactctcccatgcctagtctcgtaggttcaggaccggagcttgcggaaggctatgcggcgtttcatgtcagacttatagcggcagcgatctcgttgctggaggagagattctctgagggggagatcttaggtaggggcttatcatttaatcttgtcaacgggtttcttaaccactatcctatcgtgcccgttgatcgctgtccgagatgcggtggccgtttcggtaaacgggaagatgagcaccaagagttgggctgcgtcgcacgggaggtgtgtcaagtatgaagggtataatcagtggtgaacaggtgggaaatgcagctcgctttgacaagcagttcagggtccctcgtcggccgagcaggcggctcggtgtcgatattgagatccgtgaggacgcaacaattctttggggatcagatcgtctgcagacatttacaggaggaatgaaaccttcactgattgaggatattttacgagcgtgcgacggaactaagacggcacgtgagctcgcctctgtatgtgatgttacggagcccttgatggacaagatagtggcccttctctgggtctcgggtgctattgaggaggcgggcccgaccgatgttgaaagttctccgcttggggtccttttgtctcgccttgggaacgcaactggggcgaatgctagctggcaggaagctcagcacagaattaacagcatgccgatctgtgttatgccccattcggaacttggaacggaggttgcgggcgcgcttgctggcacctttgaggttatcaatgaagaggcagcttttgaacgcggcgtggttctattcatctttatcgaaaccgcgtcgtctaagatcgaacagcatcacaaatttgatgaactgacaaagagaagagtgctattggttagcgctgcgggtgacgaagttgtagtggggccgctttatgaccaggctataacgccctgccttcggtgctgttcgtcatcgaggatcaagctggatcggggtgcctcgagcccggcgcagcttcgtctcatggctggaattgtctcgcatcatattgttgcgttggtaagcagggcgttactctcaccgctgcccacggattccttggcgctgaatgtggtcactggtgtccagcgctactctttcccggtgtccagaccgggttgccccgaatgttcgcatgcgatcccagctattgctagtgagccgacggtcggtgccgtgtacgaggcttccgtagcactccctccgcgagaattcgtgaatgtaagggactatcaagcccacttcttgagcgcaaatcaacaacttcaaacgaaatttaagtcatggggaaaaagggaaaaattccctttgcctgacattaatatttcagacctacatatacagattgacgaccttctttttttagctgctgcccttaggtttgggttcggaatagacccggagcggaccacttcaaaaatagcgaagcgctggacggcctctggtggaaacattggctcggtaaacgcattcgtgagccttcctgcgatggtagggcacattcccagtgggatttatggatattcagttagcgatcattccctagccaaagttagtcaggagttgatttcggcgactgacatcatgattgcggcttctgccgacctacggaagatcgcttctaaatatgggacattcggcttgaggatcgcgattatggacgccgggtgtgccctttcaacggtgcgtcgtgtctgccgggaagtaggccgtacattttcgatgtggagcgctgacctcgacgctgggtctattagcgagatgctgcatctttcaagtgcgcgtgagcctattattggagtttcagtgctgggaaaggggcaacgagggtgaggacagacattcccgtaatgaatgccattctgtgtggaatttctggtttgaggccaagagttgcggagctccggctgaatcatgtaccaggagaacttgaaggtgacctgatcggcgagttctcggggccagttactccggatgaaggatcaccttgtctgccgtgcaagagcttccctgaattcttgcagacaaggaggtcggtatcccattttagagacgaggcggttgacgcacgctgcgtcatccatgcagtggctcaggctcttgaggatgatgagcgactgtgggggtgctcagagaccgctggtcttcttgaggcgtttgtctttgtgcttcgagatagtgttggcggtcctggacccgggatctatcaggtgcggcgcgattctgcggtgagaatgacaactgccgctgaacttggcgatccgattcgattcggtgttcaggaggaattcttcgcagggtcaggggtagttatcttttgcgcgaatctggacgtggaggatggcgccggaggagcaaacggatacttagttaatactctccgagcttccatggcactctacgaagtccatgttgaactcggttgcatggacgtggttggctccgttttcggaggcttcattccagcttcgctgcgatcgctcctgttggcagatatggttactcgtcagcaaatcatctcttgctcctatggttttccagcctaacttgctcgacccgccagtagctgggttgtgaattgggtaatgaatggatcgaaataatttgtaccatctgagtcgcgagaaggtaaatacaaatggaaatgaggcacttaatctcaatgtgatggagttctcggacatgattagcgacgctactgagcgcgacgacgtcactcagataatggcggcatcttgcgtcgagacgagtgtatcgtcgagttccacgtcatcttcatgatcgccaagtggcagattatggagccaggagaagaggtccgtacagggcgaatactcagacgcgacttagccttcgcagttgtcgtggaagtttatctagccgtcttaggttgtttcagcaaccctacacgggaagatactcttagcgctctggggtgggattatttggttcgccaaagcgattcaaggcttcctctctaggtggttatgattagtgtcgaaaccaattgaggggaggtgaacagaatggagaacgaaacgttggaccttgacgtgatggagctggccgatatcatcggtagtgcttctgatcaagacgacatggctcaggtcatggctgcgtcgtgcaccaccacgagtgtctcgacgagctcttcgtcgtcctcgtaacgagatgggcgggctggcgggtgcttttcgggcccgccggcccgttcctttgttatttacggttctttgcttgagcgggctgaatcgtggtggggaggttgtctaaaatttgggctcgggctcgaggccggccgcgtaaattgaccacaatgagcgtgctgcggtaacttagacgtaagatacgcttctcctgctagccttatttgttacccgtttggatttcacctagatgcacgctagggtaggctgattagcttttatggaaatgatattattattatgataattagtgtagatgggatttggaggggcatcgtgtagctagtctcaaatagaagcgatcccgcagtgcagcgtattttggatatgtccaggccttcgttcaagctggtttgatgtttttaaaggatgtggtgaccgttcacattgcgcatggctgccggtgtgcacattgttgagatgtattcggaggctggaaaggcagcggcttttttaattgacgcgtatgcaaccctgggggttccatatcgagaaatgtcatcattgttgttgtcgtaagtattcaaggtgggtaagcgccctgagattttcgctgttgatcgggtggcgcatgaggctaatgccggcgtaattgatccgaagctagatttggttgttttgaacagtttgcacaccgtcggtaatatgggggcgataatttagacctcctttgtgcttgactcaagggcttttgttctagtggacagaaacttgagctctatttccgataggagggttcttctggcttctcctagatacgtctttcttcttctggttctgagagctagtcgcgatgagcttcttgagttgtgcaccagtcgtcgggaactggtgaaattcttggcggatggctatgtggatatggcctttttctggtcttgagaccatccgatcacgatggtctagggaagcaaggataagggtgtgtcgataatttgattatcggatttccatctccgttagaattctgatgctggcggatgctaagtcattgaatgatgtgtctgtggcggtcggaattggactacatgagaggccgcagcgtgacttggagagcggatcttaggaatcagttcagggccaggactcccatccaggccatcagtttgttggcgaagctgacgatcagctgcccgatccagttctgtgtgaagccttttcaacgacagatcggtcaggctggtgtccttcgctgtc

SEQ ID NO: 60 - DNA, 11522 bp, Propionibacterium acnes
ggcccggctgttagacctgacactgggcagctccggaaccgtgtatggcgtctggctccagtaacgcggccaagcatagtggcagcaggtcgagatcaccgcgttggacccgtttcgcgattacaagcacgctatcgatgatcacctcgataacgccacagccgtactgagtcccttccacgtcgtgaaacttgccgcccaggccctcgacgaggcccgaagccgggtccaacaagcccctcaggcaaccgcggccggactggcgacccgctctacggcattcagacgatcctgcgagccggggccgagaacctgtccgacaagcaaaaacaccgtcttgccaccgcgatcgacgctaacgaggcacacgagaaaatgttcattacctggcacaagcagcgcaacggctccgggccgtcaacagaccgaccaaactctaccgcagcatcgcccgtggctccagcaactgcgacaactaccgcctactccgcctgctcatcgccgggggcaagacacacgaaccaccgccaagtcagacgagccatttatagcccaacagctatttgggtggtcccctcagcctgacagcgccagacgtcggtccgccatgttaaactgaacgcgtcgcttaagcttcgggaatagaaatgggaaacggtatgactcaaatacttattcaagtactcccggaatagacattcttgcggcgcgctcagctctaatcatttcgtggccgcctctcctacgacgaattgtgcattagggaagtacagtgcatctcagtccatatgtagtctttcgcaggacacgactcgcctactctcaacttcagagcagctccttcgacacactctggcagcaagtgcaagaaatggtcgataaacatacgcaattagaggttcagaccagcaggcttacggcacacctggagtctgttatttcagtaactgcgcctcgtgacagatctcgactaatcacattaaaacgtgacgtgcataacatgcgcgtggaaaaagtgcagcaaagactgctgcactgtcagggctgcacggctagcaacattatggagcctgtatctagttggatcgatacatgtcgatcatacaaatacttgagcgtcggttaagtcaagtatatgcggacagccgagacgaagtgtctcgtcactacaggtccctctaccaggctgacgcaatagagccaagcattcaactctcaggtggccagctccacagtgacctgacacgtctgattagccacgattctaggataaaacccactaaagagcggactatggaaacgactcttgtaaactatctctacagggcagcaacaaagccatcacctttcggtcgtttcgtggaagtaggggccttcgacccgtctcaaccaaattccgaacctcgacgctgcagcgaatccagcgtgacgacaaaccggattcttaccagctggctcactgcagtaacagcgcattctttcgccgcaccagaaatgcttgctatcctcaacagcgccctgcgcgttaaacgcgatataatccagttcattggaattccacctggggagtggcgaggtgcaccgagcattcccgaggagcgcctgctaactatccgcaagcgcgaagatatgatgtctgttcttaagctcctaatgggcggcccaagatcagtcggtgacctcattattgcccttaatgaccaaggcatagatgaatcacacgcaactaatcttctcagcagtttgagtacagcagggataatcttctttcggctcccagtagatgaccatgacgtacattatgtacagactgcgtgtacagcgctaaggttaaccaaagatgagtcacttcgtgccgctttctaaagtctggcgaacgctgaaaaggagttccccacagcgtcagtcgccacgcgtcacgaccttctcctcggcatcaaggattccgtgaacactgtcgcgacggcacatgatgtgccgaccccaccggacagcgcactcaggagccctttgtatgaggacctccccgccaccgcgacaccccagacatgggattcaaacacggttgagagatcagcccgcgcactcaggagcatctggctactgagcgatttaatggatagctctcaacgccgacagttgggcctctcccagttcatagcggacatgaataatggcgcgccagttacttttcttgatttcttcgactcgttttcgcgccttagcattcgcgagcgccaaggaatcctgcgcggagaaaactcaccgcgaatcgcccgtttcgctcagcaatatagtgatgcattgcttaaaattcgcgatgccgttaactacacgcagggcgaagcccaccttgaatctcaggtaattctcgatgcgatcaccaatattgatgatttccggccgactaagtcgatcacaattcgaggacaattcacaacatcgctcacctcccatataagccaactgataatcaacggtgttatgacgggatacggtacatacatgtcccgattcgcaacatttgtaaacccaacaggtacttggaacctagccgacgggattcggagacatctatccgatcattttccaggtcaatgtgatttgaattccgtactgggattcaacttcaatgttcatccgcaaatgacagcacatagtatcgcctatcctggagtagttcctgcgcttgatggcgccaagacacattcaattcaggatttaatactgattccaactgccgaagcaggtccacgccgcgtcgctatctttgatagagcagagaacgaaccgatcgacctccagcccatgaatttcatggttccttttggggtacctttgctgtatcggactctagagttcctgtgcccatcgaccagatacctatggaacccagctcaagaccttctggatatcccaatgatagagaacagttgccctcggatttactttgacgacgtagtggctcaacgccgttcctggacgtgcagcgccgagacgctcccgtgtcccccagagaaactctttaggggtgatcttgctgctttgcaagccttcgactcgtggagactgtcagcgagggtacctagacatgtctttgccctagtacaaacggctacggaaagacaaatattttccggagcggccgacgcgccaaccttgctctccgaatacaagcaccttcggagagcaagtgtgcataagccaatctacctggatctacgaaacccacttctagtccgttctctcgcgaaggtgatcatgtccaggcccgaactatatgtcacgttttccgagttcctcccatcggaggccgattacacgcagaacgggagccgccccagttacgcagaggagtacttcattgaactgtgtgccgagtgacagcgcaagcatgtctgatcccggcggctggcgggcgctccatattcacttgcctccctcggtgcagtctgagtacctagctgacgtgattcttccctcgatgtcagccttgatgccagaacatgactacttcttccttcgatattggcaggggggatcacatctccggcttcggctccgtagcactcccgagcaccccctagatgatgaggctatcaacgaggttgcatgccatctccgtagtcttctcccggcgttgtcagaccaaaagcgcgcggagtaccgctattcgcaatcgcttcaggatcagttagccgaaatggaaagggctgattgccttcccctagaggcggttgggaccgtggtagagcgccggtaccagcctgaatatagaaagtatggcggatcggtcggagtatccattgcagaggatgttttctgtagtactagccaatctgtccttcgcattctaaatgagcggccaattagccaccgacagcccttggggtatgcttgccaagttttcatccagatgctgggctgcttagggctcgcaacttcgcaggtcgaccagttcctcaccagatatgcgcagtggtggaccccttactcaatggccgctcgccctgagaccttagcggcgcgtctctacgccaacttgtcaagcgtggtggcggacctatgggccgcaagtgagcccaacggaatgttctcggttccggctctcaatgcttatacccaatggtcacggcgacggtcgtccgcgagaaataccagcgtaaagatagacccaatgtttctatcttgcttagcgaactacattcacacaaccaataaccgacttgggctcccacccgccctagaatcgacagcggcatatcttgtccaacttggattccgatcggtggctgtcagggaggagaaagtgcggtgaatccaaaaaactccaaagcgacggaactttggtttcagataattcagactcgccatgtactcttcttctcgacttatctcgggcctccaccgagggcactgagcctagtcctcaatactactgtcgaacttgggaccctacaacaaaagaccccggagtaagggttggcatacttgattccaaccgcttaactgatcaagcggctttccttggcggttccggtattacgcatcacttcttggtaatgaaaaaaccacccagctggccccttctatggaacgcgggtttcgcgggcttgaagctttccacgataagcaaacaattgttcaccgcgtcatatccatggatggtaaagtgggcgctacaggcatcggcttggacggacgacgaacgccttctggctcttacgaaacttctagttgcccacgctgatgcaagccttccaccggtcgataagactgaaatgctcggccgcctccctttgaagttgagcttgcgactgatcacatatcgttcccactacgaaagcatccgcgctcgcacgattgatccgaaagcgatggatactgcggttaatcgggccttcatgaagtatcaagacgagctccagcgatggtcccagtcgttgacatgctcgtcgagctatcgtgagaaagaatggactaatcccaacctttcagagtggagtgccatcatttattgccatctcccacaaattaggaaactcctcagcgggggaggattaactgtcgcgggcccgacacgcgaggatatagaagcctccttaggtcacagtattcctgatacacgatttcacgagcgccttgaccccgccatgcagtattatctcaatcatgaccaagacttcacggcatacagattctgtacgggttttttgtacagcaacctgtactcgctgggaataccgttgaggctgcgctaccttgtctgtgggctggcagcacgtttcaacgaggagctgtcgggcacgacgtggcgcgatttacgggatctcttccacgaggctgctactgtcgcatattacacacgcgacacagacgggagcgggattagataatgacagtcgagcgtcagcccctgcgggagcgtgcaaggagcctcgtttcaccatacggactagtttctcaagtataccccctgcatgccaatgaagcagatccaccgtttcatgtgcatttgggtcgaacaggccactcaatacacgaggggcaaattacttttgagggagatatcggaaacaccgacgaggcagggtcggggtccgacagtaccacggcagaatttattgcagtaatggagtccttagagcgctactccagcgcaatgtgggacgctcgttccttcttgctggaatcggaaaataatctgcaggagcgatttgtatctcccaaccaattcccacgctgttctacagccgagctagattctggacatgtactaaggcggtacgacccgggcgtcccaatacgatgggtcagaggatggtcactgacttcaggtcatcaggtgtgggttccggcgatcgcggtttatctgcatctgccgtacttaaacgactctgaacgattcatacgttcagtctcgaccggatgtgcggttcatgaatccatgcggaaggctgttcttaacggtcttttagaagtcgtcgagcgagatgctattgctttgacttggttgcatgagttgcccttgcccagaatcgcggctggcgagaccggtgagttcccgccggaagcgctagccggttggaagtcatatagggattacggaatcgagactcatctctttgacgcaacgacagattttgggattccggtgatctttgcgctccagacatcggatcaggatgacgacatcgcacagctcgtaggtgctgcatcagctttggaacccgctgaggcgctgactaaagtattcagggaaatggcatcgattcgaatagcactacgcgcctttctcgcccagtccacatcgattaagattgactccgatgtggctaacgtgacagggggtgctgccctcatgggccagcgcgcgtaccgagatgcattttccttcctccttaacagcgagcgcgaaacgtcaccgtcgcggatgcctaacctcctagagctgaatgatgatccactgcgcgagatgattattcgaatacgcctggctggcgctgaagttatcgcggtcgatatcacgacggatgaagcgaggtcagttggtgcaagagtagtgaaggttttggtcccagaggcggttccactctcctttgttcaccgagagaggtatttagatactcctcggctcatatccgcgcctaatagcatgggatatttggttgacacagcgcctacgttcaaccggaacatccaaccttttgcgtgaaactcatattaaggaaggccagaccgactaatggaccgcttcgttgtgactcggacgctcttcggcgtggagctcgctaaagaactccagtcctccatcttagaggatgggccatacataggcgactcagttcctcactggaaacaaaatcaattactcgtgtacgtgacgacagatgaggcatccccaaggttggactcaattgacggcggggcgttctcagctggccggccttggcttcccgtccgtcttcgacccacagtgattcactgcggccccataatttggccaggtagtacgccttgcttccggtgcagtgtgaaccgaatgaagcagcactctcccgtgcctagtctcgtaggttcagggccggaacttgcggaaggctatgcggcgtttcatgtcagacttatagcagcagcgatctcgttgctggaggagagattctctgagggggagatcttaggtaggggcttatcatttaatcttgtcaacgggtttcttaaccactatcctatcgtgcccgttgatcgctgtccgagatgcggtggccgtttcggtaaacgggaagatgagcaccaagagttgggctgcgtcgcacaggaggtgtgtcaagtatgaagggtataatcagtggtgaacaggtgggaaatgcagctcgctttgacaagcagttcagggtccctcgtcggcccagcaggcggctcggtgtcgatattgagatccgtgaggatacaacagttctttggggatcagatcgtctgcagacatttacaggtggaatgaaaccttcactgattgaggatattttacaagcgtgcgacggaactaagacggcacgtgagctcgcctctgtatgtgatgtcacggagcccttgatggacaagatagtggcccttctctgggtctcgggtgctattgaggaggcgggcccgtccgatgttgaaagttctccgcttggggtccttttgtcccgccttgggaacgcaactggggtgaatgccaactggcaggaagcgcagcgcagaattaacagcatgcagatctgtgttatgccccattcggaacttggaacggaggttgcgggcgcgcttgctggcacctttgaggttgtcagtgaagaggcagcttttgaacgcggcgtggttctattcatctttatcgaaaccgcgtcgtctaagatcgaacagcaccataaatttgatgaactgacaaagagaagagtgctattggttagcgctgcgggtgacgaaattgtagtggggccgctttatgaccagactataacgccctgccttcggtgctgttcatcatcgaggatcaagctggatcggggtccctcgagcccggcgcagcttcgtctcatggctggaattgtctcgcatcacgttgttgcgttggtaagtagggcgttactctcaccgctgcccacggattccttggcactgaatgtggtcactggtgtccagcgctactctcccccggtgtccagaccgggttgccccgaatgttcgcatgcgatcccagctattactagtgagccgacggtcggtgccgtgtacgaggcttccgtagcactccctccgcgagaattcgtgaatgtaagggactatcaagcccacttcttgagcgcaaatcaacaacttcaaacgaaatttaagtcatggggaaaagggaaaaattccctttgcctgacattaatatttcagacgtaaatacacaggttgacgaccttcttttttggccgctgtccttaggtttgggttcggaatagacccagagcggaccacttcaaaaatagcgaagcgctggacagcctctggcggaaacaattggctcggtaaacgcattcgttagccttcctgcgatggtaggacacattcccagtggggtttatggatattcagttagcgatcattccctagccagagttagtcaggagttgatttcggcgactgacatagtgatcgcggcttctgccgacctacggaagatcgtttctaaatatgggacatttggcttgaggatcgcgattatggacgccgggtgtgccctttcaacggtgcgtcgtgtctgccgggaagtaggccgtacattttcgatgtggagcgctgacctcgacgctgggtctattagcgagatgctgcatctttcaagtgcgcgtgagcctattattggagtttcagtgctgggaaaggggcaacgagggtgaggacagacattcccgtaatgaatgccgttctgtgtggaatttctggtttgaggccaagagttgcggagctccggctgaatcatgtgccaggagaacttgaaggtgacctgatcggcgagttctcgggtccagttactccggatgaagtatcaccgtgtctgccgtgcaagagcttccctgaattcttgcagacaaggaggtcggtatcccattttagagacgaggcggttgacgcacgctgcgtcatccatgcagtggctcagggtcttgaggatgatgagcgactgtgggggtgctcagagaccgctggtcttcttgaggcgtttgtctttgtgcttcgagatagcgttggcggtcctggaccggggatctatcaggtgcggcgcgattctgcggtgagaatgacaactgccgctgaacttggcgatacgattcgattcggtgttcaggaggaattcttcgcagggtcaggggtagtcgtcttttgcgcgaatctggacgtggaggatggcgccgaaggagcaaacggatacttagttaatactctccgagcttccatggcactctatgaagtccatgttgaactcggttgcatggacgtggttggctccgttttcggaggcttcattccggcttcgctgcgatcgcttctgttggcagatatggttactcgtcagcaaatcatctcttgctcctatggttttccagcctaacttgctcggcccgccagtagctgggttgtgaattgggtaatgaatggatcgaaataatttgtaccatctgagtcgtgagaagataaatacaaatgaaaatgaggcacttaatctcaatgtgatggagttctcggacatgattggcgacgctactgagcgtgacgacgtcactcagatgatggcggcatcttgcgtcgagacgagtgtatcgtcgagttccacgtcatcttcatgatcgtcaagtggcagattatgaagccaggagaagaggtccgtacagggcgaatactcagatgcgactgagccttcgcggttgtcgtggaagtttgtctagccgtcttaggttgtttcagcaaccctacacgggaaggtactcttagcgttctggggtgggattatttggttcgccaaagcgattcaaggcttcctctctaggtggttatgattagtgtcgaaaccaattgaggggaggtgaacagaatggagaacgaaacgttggaccttgacgtgatggagctggccgatatcatcggtagtgcttctgatcaagacgacatggctcaggtcatggctgcgtcatgcaccaccacgagtgtctcgacgagctcttcgtcgtcctcgtaaacgagataggcgggctggcgggtgcttttcgggcccgccggcccgttcctttgttatttacggttctttcttgagcgggctgaatcgtggtggggaggttgtctaaaatttgggctcgggctcgaggccggccgcgtaaattgaccacaaggagcgtgctgcgatagcctagatttaagataaacttttcctgctagccttgtttgttacccgtttggatttcacctagatgtacgctagggtaggctgactagcttttatggcaaagatattaccattatgataattggtgtagatgggatttagaggggcatcgtgtagctaatctcagatagaagcgatcctgcagtgtagtgcattattggatatgtccaggccttcgttcaagctggatttgatgctttttaaaggatatggtgaccgttcacattgcgcatggctgtcggtgtgcacattgttgagatgtattcggagactggaaaaggccgcggctttttcaattgatgcgtatgcgaccctgggggttccatatcgagaaatgtcatcattgttgttgtaagtattcaaggtgggtaagcgccctgagattttcgctgttgatcgggtggcgcatgaggctaatgccggcgtaatcgattcgaagctagatttggttgttttgaacagtgtgcacaccgtcggtaatatgggggctataatttagacctcctttgtgcttggtacaagggcttttgttctagtggacagaaacttgatctctattttcgataggagggttcttctggcctgtcccagatacgtctttcctcttctggttctgagagctagccgcgatgagcttcttgagttgtgcaccagtcgttgggaactggtgaaattctcggcggatagctatctggatatagccttgttctggtcttgagaccatccgatcacgatggtctagggaagcaatgataagggcgtgtcgataatttgattatcggatttccatctccgttagaattctgatgccggcggatgctaagtcattgaatgtgtctgtggcggtcggaattggactatatgagaggccgcagcgtgacttggagagcggatcttaggaatcagttcagggccaggactcccatccaggccatcagtttgttggcgaagttgacgatcagctgcccgatccagttctgtgtgaagccttttcaacgacaggtcggtcaggctggtgtccttcgctgcccagtgtcaggtctaacagccgggc

SEQ ID NO: 61 - DNA, 2881 bp, Propionibacterium acnes
gccccacctcaggcccgaagagccagacaactcttgttgaacttcaaagccttgaaatcttcggtctgctttttaatgctggtctctgccgggaatcgctcgatggaagacgcgccgtagaagcctacgatgccatcggtgtgatcgagaatgtattgcgcatcctcgggattggcgatggggccgccatggcatagacataggatgtcgggattgacagatttggcagcgtcggcaagttcttgaaccttgacagcggcgtcctcgatagtgagtgctgtttttgcaccaatggttcccgaggtcggcagacccatgtgggggacgaggatgtcagagcccgctcgggccatgtccttggcctggtcgacatcgaaaacatagggtgaggtgaggagatcaagatcgtgggcaattttgatcatgtcaatctccaaaccgtaccccatgccagtttcctcaaggtctgcgcggaatgtgccgtcgatgagaccaacggtagggaagttctgaactccggcgaaccccgcgtccttgatctgggttaggaactgaggcatcaccctgaaaggatctgtgccattgactccggcaagaactggggtgtgcttgacgatgggcagcacctcgcgcgccatgtccatgacgatctcattagcatcgccgtaagcgagaagtcccgagagggagccacggcctgccatccggaaacgtcctgagttatagatgacgagcagatcgataccgccggcttccgcggatttagccgtaatcccggtgcctgcgccgccacccaccagggggattccgttggagacctgttcgcggaactttttcaggatttcagtgcgggtcatgatgctattcctttccgattagttatggatgatgagctcgtgaagagcccgcgccattgcttcgccaaaaccagtatcattgatattttgttttcgctcagtcacagtgatgtcggtatccttcagtccctctcgaatggcgttgaacaaagcgtcatcggcttctggatcatagaaatcttcacctggggtatctattccggagaccccagagtaggaatgaaaacttgagtcgggtcgcgcgcagcggccgcctttatggcgattctgtgaccaagctcggccatttcggtgtcgctcgttcgcatgagcgtcaccgctggattgtggatatgcaacgtgcgagaggaatagcgctccggaacagtgtcgacagggccgaaattgaccatgtcaagcgcgccaagactgatgacttcgggtattccaaggtctgctgcggcttccatccggcggggtcctgccgagagaactcctccgcagaggtcgtcggcaagctcggtagtcgtcaggtcacatattcccgcgagtagcccagatgatgcgagcttttccatcgccttcccaccggaaccagttgcgtggaagacgagaacctcgtacccaaggtctgtcaacgtcctgcgggcttcgtccgcagcgggtgttgtcaatccggtcatcgtcaggccgatgaccggtttgttgtgagcggtgttgctgacgattccagcgtcttcgtaccctttggccatggctgcgatagcggcggctgcattggcgaagaccatgcgcgacacggaattgatgccggccacgtcaacgacggagtacataagtgtgacgtcggcctgtcccacataggggctgacatccccggaagccatggtggaaaccaggagcttggggaatccaatcggcaatgcctgcatgaccgaagccgctacggatgatccacctgatccgccgagggacaggaggccgtggattctcccttcttcagcaagcctggatgcaataaccgatgcgccacggcccatgacatccatcatttcgccacggttatagcgtgttcggatgtcacttggcgactcgcctgcggcacgaatgacctcatcggaagtgtagtcggctatgcggctgttggagaatgaaccaacatcgatgatgactaccttgccgccgttggtaagaatgcggtgacgaagccagtcgagctcgtctccctcggtatccaaggttccgagacagcaattgcggccatgaacactccttcgtgatcatgtcatcatgaccgtagttcggtgattctgcctgcaccatgctgcttgagacgaattggcctatatggttgtaccgctggttgcgaagaagggcaatacttcaggtgtggttgtcaaggttgaccctgcaagtctgagccggatgctggggggccagcccggagaagcgcttccggaagcgttggcggacgcattgctggatctcattgacgctggttttctgcccgctggtgcggttcttccaccccaacgagcatgtgccgcgacactgcaagtatctcggcaaaccgtggcggaggcatttgggattcttgaagccgcaggccacattgcggcgttggttgggtcagggacgcgggttagatcaggccgcgctgcagtgagtactgatggcaggttgttctcgttcagtgaggctgcacctggcctgatcgacctgtcaacgggggcgctacctgcgtcagaggtggtgcgaagagtgctgctagaagaccacgtcgacttggatgagtatttcgataccgacggatatttcccggctggactacctatattgcgtgcggctatcgcggaacggctcactcgtgatggagttcccacagtcctgcagcagatcgttgttaccaacggcgctcagcatgcgagttatcttgcctctcagctcctggtctcggctggtgacaccgtgttggtggaggagacgacatatcggggtgagctcgcagagctgcgactgctgggcgcccgtgtggagagtgtccc

SEQ ID NO: 62 - DNA, 10252 bp, Propionibacterium acnes
cccgctcactgccaacgagacatcacgcagcagcggccgaccatcggccagcgtgtacgtcaccgacgcgacatcgagacgaaccatgacccaaaagtatcacacgtgtgataaatggaggttgagtatggcggcctgttcacttgatcaggcatttcttttagtgaggcctggggcgtaaccacttgtctgcaccttagagctgccacgcctcttgcagatcgaggcagaggaggctgcgcgggggtcgtggcgtgcggtggcggggtttgatgtcacgttcagtgtgccgaagtcggcatcggtgttgtgggcggttgcggacgcggggacgcaggcgttgattgcgcaggcccatcatgagacggttgtggcggtggttgcattcatggagtgcgaggttgcagccatccgcacgggtgcaactgctggggatggcgcggttgcacaggtcgacgtgacgggtttgatcacttcgattcccgcgccggggacccgcacttgcatacgcatgtggtgatcagcaacaaggcccgcacggtcctggatgggaagtggcggagtttggatgggcgttcgatgcatgccgcggtcttggcgctgtcggagctgcacgaggccgtgttcgccgatcacatgacccgcacgttcggtgtgacgtaggagccgcgggagatgggccaggaccggaacccgtcgtgggcgatcaccgacgtccccgaacagctggtggcagagttctcgacccgcgcccggcacatcaacgaggcgaccgacgcgctggttgctgactacgtggcccagcacgggaagcgcccttcgccggcgaccatcatgaaactgcgcgcccaggccacgctcgcgacccgtccggagaagcaggtccgctcacttgcggagctaacagccgagtggcgcactcgtgtcagccagcagctcggtgtggatgccaccgtgtgggcgcggaccgtcacgggtggggagcggcagttgctgttgcgggctggtgatgtgccgttggatctgatcgaggggtggggcggtctgtagtcgagatggtcggtgagaagcgttcgacgtggcggtgctggaacctgatggccgaagtcgcctgccagactgtggggtggcgtttcgccaccgttgaggaccgcgaagtcatcaccgcgatggttgccgacgcagcggaacaggcgtccttacgcctgaccccacccgagctagcgaccagcccggcgaagttccgccgcccggacggcactagcgtatttcgtccgaagcactccacggtgttctcctccgacagcctcctggccgcagaggaccacctcctgcaacgggcccgcaccgcgaccggtccgactatcgacctgaccaccgtggggaccatcacgagcaaggcggacagcgagggtcgggtgctcggtcccgatcaggccgcagctttggcgtcggtcgcggtcccgggccgggtggtggatgtgttggtggggccggcgggggctgggaagactgcagcgatgaacgcaccgcgccgggcgtgggagacggagcatggtgccgggtcggtggtggggttggctccgtcggcggtggcggcccaggtgctggccgatgatctgaggattgccacggagaacacggcgaagtggtggaccacccaccaacacaccggcgtcactttcaaggctggtcagctggtcatcatcgacgaagcttccctcgctgagaccctctctttgaatcggatcacgctggctgctgaggaggcggggacgaaggtgctgctggttggcgactatgcccagctcccgtccgtcgatgccggtggtgcgttcagcctgttgatccacgaccgccacgatgcccccgagctggtcgatgtccaccgcttcacccacgcctgggagaagaccgcatccctggagctgcggcacggccgcaccccggtcatcgacacctacctggcacaggatcgcatccacgacggagacgccgaggccgtgaccgctgccgcttacaccgcctggcgccacgaccggcagcaggggttggcgtcagtactgatcgccgaaacccgcgagaacgtcaccgccctcaacatccacacccgcgctgacctcatcctggacagcacgttgaagcctggccccgaaatcaccctgtccgacgggtccatggcaggcgtgggtgacacgatcatcacccgccgtaacgaccggcggctgcggaaccggcacggctgggtccacaacggccaaacctggaccatcactgccgtgcgtgacgatgggtcggtcacgatccgcccacccagtgcccggttcggcaacagcatcgtcctacccgccgactacgtggctgagcacgtcgacctcggctacgccgtcaccgctcaccgcgcccaaagcatcacaccgacaccgcccacgtcctcgtcgaacccacggcgacgcgggaaacctgtatgtggctatgacgcgcgggcgcgaatcgaaccgggcctacgtcatcctcgaccgtgccgacgaccacgccgccggcgccgtgtgccgtgtgaactcggtcgacagccccggacgctgggtcgcgcggtccgtgatgagttcgtcgacgtcggcagcggaggtaaccaggcgtgcgtggccggtacggagcagctcgtgcgcaccacggctggtgacaggccccggcaccgcaccgacctggcgtccgagctggtgggcctcggacgctacccgaagcgcccccgatcgcgcgccggcctcaacgaccaccgttgctgctgacattgcctccaaacagtcgggagcgggctaggagccgatgccgcgtcgacacggatccgggaggaagctcgctggccagcgcactcacatcacccacccggtccagcaagtcacggtggccgctcgggtcggggcggttcacgccaccgccaacaccgcacggtgcacagcagcctcgacaccattaagcgtcaccagccaccagtacacgctcacggttcgcgaggtcgccagccagctcggcggcgacatgctccccatacgcggaagccgcccgagaacccgtgaccgtcaccagatcgttccacggtcgcgccaagaacgacgccgcgccccgcacgaacagaataaacggagcgcggtcgcccagatcatccagcgcctgtggccagtgcgcgtcacccggaatcagagtggcgatcccgctctcctcgaccatgcgcagccgctgggcgagcccatccagcctgcccggtgaggtgaggtggtcacgccacacctgaccatcaactcgactcagaccaggcacggtggtcgtgtcggtgtcaagcagcccgagcgtctcaacggcacccaggcggcgcatcagcccgcccgtgacgggatcatcaggctccgccaacagcgccagcaccacccgggcacgacgttcatcaacaccaagcccagcaacaccagacatgacggctcctcctcgaacagacttcgccgaacaggtgcgccaacgcagcccgcaggtgtcgcgacgtcctcagcccgtggaggctggcgaacgcggtaacattcgacagtcgcacggttcggcagctcgacacagcagcgtgctggtgttgctttggaggagtccacgggcctcgccccccacaacggtgacttcaatcgacattgtcgttgttggtgatcgaggtgtcaccgcagctgcgaacgatagtcttgatctggacaacgatttcgatgcggaggaaagcacatgaggctcacacgcttcaaggtcgagaaccataggcggttggccgacctcgacattgaggtgcgcgaccaccttgtgctggttggagccaacgacgttgggaagtcctcgctgctccggtgcctcgatttgctgctcggggcgagtacggcgcagctctactcccgtatttcggccgacgatttccgagcccccgaccaaccgttcgtgattgaagggactctcgcggacttcaccgatgtcgacaaggctctgtttcccgatgagatccacgtcgacccgaacacgaatccttcgcgtctggtgattaggctcacggcgactgtggatgagaacgagacggtggtgatcagtcgttcggcccccgagggcggaacaggacgccagctctcacgggatcaggtgcttggcctgggatggaagttcctcagcgcaaccgcccagacccgcgaccttcgggaagaccgaaagtcggcactcgacgacatccttcaagctgtcgacttgggtgaagaggaggccgcgttcgaagccatcgcaaagagcctgacgaccaccttgggtagctctaaggtgcttgaaggcctccgaggttcacttgctgaccagctgtcgaaggctctgccggacaaggtggcacaggatgacttggcgttcgtgcctggagctgctgccgacaatgacgtcctcagcgacgtgcggctgcaagtcagcaagcaaggcgtggcacccgatctttccgaacagtcagacggcacgcgagcgctctacgcgatcgccctctacgatctgatgagcgtcggcgctaacatggtggggattgacgagcccgagatccatctacacccgagcagtcagcgaagcctcgcgcgcctcctgcggtcgaacgccaaccagaaggtcatcgctacgcattctgccgacatcgtaggagccttcgatccagattctattgtcgttgtgcggggcggaggcgaagccgttcaacccaaggctggattcctgtcggacgatgagcgaatggcagtacgcctgtgggtgagggatcggctcgaaccactcactgcacgtcgtgtcgttgtcgtggaaggcatctcagatcggatcatcctggagcacctggccgacctcaccgaccgaaatctcgaccggctcggcgtgtccttgattgaggctggcgggtgtggcgacatggggccgctcgacaagctctttggtgccaatggcttccgtgtatccatgtcgcaactcatcgatgcagatgcagaagaggcattggcaaagaaactgggagtcgaagttgctgaccttgcaggccgatccgtctgggtctcgcgaagcgacctcgaagacgagtacgttcgtgcgctcggctcggacgccgtgtggacagcactccagtcaaatggccacttctcgaagaatgaacttggcaactgcgcagcaagtgggccggctggcacgcgtaccgagatagatgttgctgccttctgtcgacgaaaggcgtacaaagtaaatgccgcgctatcagtcctgccgctcttcacggcggcgaatgccacgcaggtgtcgtctatcgagagtctactcgaagagatcgtggcgtagatggtcagcccgactcagaagcagattgacattagggacacgcgggttctcgatcttcttgtcgttgctcctgcgggatgcggcaagacggaagcgcttgcattacgaatccaaggacttcttcaccgcggcgatgtgactgccccaaagaagatcttggtgacaacattctcgaaccgagcccgcgacaacatcagagaacgattggggtcctacctgacgccttcggtaatgcgcgaccgcgttactgttgtgaactttcatggactggcagcccggttgatcagagcgcacggaaatgttatcggcctaagtgaggaactacgccttccggagaacgactgggttggcgagcaactccgccaacgcaacacctcctggaatgaccgaggagcgatccagaatgcgcttcgtgagacaaagcaacaacctttcagcgacgcagcggtcgaagctgaacttgaacgactcggaaatgtcactgcacttgaactggaacggctcagaaaggaagaaggacgcctcacctatgatgatctgccaagacttgccgagctgattctcggttacgagagcgtcgcggacctctacgcgacacacttcggcgctgtcgtggttgacgaattccaagacctgactccccagcaactccgaatcgtaaacagaatcggttacaagcgcacaacctatggcggtgaccttgtgcaggggatctatggttttgcaggagcgcagccactggcaattgatcgggacatacgtgccgagtgcacctgcgtgatcgagttctctgagtcgcatcgatcctcaccggcagttctcaggacggtcaacgcccttatcccgatcacgtcgggacaggtactcaccgcagccaaccccgactcctggccttcgggcgggctcaccgggacgatcgtgcaccaatcggcggaatcggaagctaagtgtatcgtgaaaattgcgcgagccatcctcggcagggctcccgggcatcggattggagtgttatcccgaacagcgccgcgtcgccgattcgttgacgcagccttcgccgcggcaacagatatacctcactacaggtgggatgacggcgtgttggacacagatactgccaaactcgtaaaggcaatgctcgcgaggtttgatgtcgccgcctacactgccgcgcccgacaaagtaactttccttcggatggcggttgactttgactcgatcactgatgtcgacacgcgcaagagcatggcggatgctctcggttgggtacaagatctgctgtctaaagcggtgaagccagagagcatccgtggacgcatcaaggttggcgattcagcgaccctcatcactagccctggagtccatctactgcgcggacacgtcggcaaagggcaacagttcgactgggtgattgtcgtaggccttgaaaagggctccattccgttcactatggctgacacatcagacgacgagatcgctgaggaagcacgagtgctttccgtgatgatctcacgcgctcggcacggcgtcattcttagccgagccaactcggttcggacgaacggggggcaccccatgagtcgaactccatcccagttcctcgaatggattgccactgccaatccactcgatgcgactgggatcatcgagtggttcaaagctgcggactggcgtgtaatcagtgagagatgaccaacgttctttggagagaagtgcgctgtccttgatgatgatccacctccgacccgcgcaaccttgggcgccggactcaccaggttgcagatcggatcagactggtaagcaagcgcccgtaaacctcgacttccctgaacacgggcccaggtcctattgaccccgttcagagagcacgagttcgtccagtcgcgctgcgcacccgatcccacgtcgtcagaaggtgagcggtagccagccagggtcatttacaaagcgctcagcgcgatctacagtagatagtaaggcaggttctcgtctcttgcgggtccatcgggacggcctacgggcgctcttccacgtactgtttcctcgacggagtagcacgtgtgacgagagagcccgatcatgttccgaaccatctggacgctcagcattcatgtcgatgactgtcttccagcactacatgccgagcaaccggctgctggcagctacgcgaactcggcgaggtgtgaagtggggtgtctcggcaatgctcgtcggcgtcccgtatctcgccatcgccaacgtgttcaactaccctgactgaccgttctgtggtgacgtgcaacggggtatcgatgttggtgtgcgcgaggacgttggttgtgggctcgttgtcgggtgcgtaggcggcgttctcgtcgttgtcaatagtgatgcgggtggatagggcacggttgaggattcgccgctcggctggcacgtacgttctcgactgtggccacggttagggcgaggtgtgctccaacggtgtcaacccctgggccaatgtgttgatgaggtcacggtgacgagtatgtggtcatggccgcacactccagattgatccggcaggcttccagggtggtgaacctcgttgaggggtccagctaagtacctaaggtcatggccaagcacgatcgcattcgctttgccgtgtgctctctttcggatcatcccggggagcacacaagatcgcccgaacaatggcgatcttgtgtacagtgactttgctagagatgttttcccaggaccgacagtgactgccagtgcgatgttcgaggtagtggtgaaactacgggtgtacaagatctgggtggccgtaaacgaggttgcctcttgggctcaggtcctgcctgacggaacccccctatctgagccctggccatgacgggtatgccttagtcaacgtggctgaagtgtcctgatatcgcagcatcagtgactagtttggtaactgtaatgccgccgcacccgttttacttactttcgatagaaagcgggtactctgtgcactttgcagggtttttgccttcgttgcttcccgtgcgacttactgtgtcttcttccttggggaggtgtaggggagggtagaatgttcgtggactagatcaacttaaccaacttacgggttgtaggttaacacctatctgtcaaccttgacactgtaatcccattgttcagcaggcacactgtcatacatctcactatctgtaaatgcagagcctgtggtttcaccaccaaagcctaactgccttaaatgtgcaatcccgttctgtgctccctccaaatcgatccgctccagtgtttcatcagcttcagaagcatagaggaacgtcacgctaacctacgatttggttctgggttgaatttttaggcgatctgatctgaagtttcgcgcgcctgcatagcccgatccgcaatctcgtccagcccgctgattatgtgatgcagctcacaagtagttagtaacaggacctgctccgcggcctggcctctatcggtgatcagcatgtgtccacggcatcttatccaccacgatgtcgcaatagttgcactgattctgacggcaccgccaacattcggtaagtgtaggataggacaagccttgagagtgtggatggaatgtgccaactctctcagtcctcaaagcatcagtggctagatcaacaaacatcgtaaacaggttgttctctcttatagcgatgtgtctatcgaagcagatgaacgagtcatctgccaggtatgaatgattgccatcactagtaacctctgcgtacggcagcaagacgttactgatgtttgagattaggagatccccaaaaatagatactcggagcgaaatagtatctatacctacgatgatgccgtgaacactactggtttctcaagcaaccagatccgcacatttaaaccatgtgaaacgtccggtaaacattctgctgtaagtcacccaggtgaccccttggagaaagttatttcagggctatggggctcgggggtgcgagaggattgttcgttgctcatttcggattatctttcagagatgagcaaccgcaatcggcattgaccagaagcgggtaaccggttgaccctagacagacttatgtttggtattcgtcaagcccccatcgggcgactggaacctgatcaattagatgatttgattgctattcttagaagaatagtttcctagattttatagcacttcccctaaacgtctaagtatgccctaaatcgtagctctaatgcagatgggcgggcgaggacgttccgggaagcatcgtcaagagtgtcgatgtcgcctgctctagctaagactcgctgcctaggaaaatcctgaacccaagtggctcggtattcgggggtgtagttcctggcgctatcggtgatgtccatagcagtcttggcggcggacgtgttcgttaagtcaataggactccagctggttttgtactcgtaatcttcaagatcaacatcgattcttagctcagtattgaggatctcgatcatgaaactcgaatcagagggaaaacttaactatcatatgcaatatcttcttaagaagagcgcttgccgactacgttatcaagcgatcccacgagcaccaatctggtatcggtaaaagtgttcgcttttctcggcggaaaatccccaaaatgcttggatatttttcttgacggatgaacttggagaagcgctgttctaatgcggcgtcacgccagacagtgtgcgcccggcatcgcccaagcctgagtgtccgaaacatgcttgatgcgtgtgaagcgttcctgcgaccaaggctcagcttgctggggatgctctaattacttctgctgctcgatagtatgcgtcctaggatagacgttgacttgagttgaggttgtctggctcttcgggcctgaggtggggcagc

SEQ ID NO: 63 - DNA, 10217 bp, Propionibacterium acnes
cccgctcactgccaacgagacatcacgcagcagcggccgaccatcggccagcgtgtacgtcaccgacgcgacatcgagacgaaccatgacccaaaagtatcacacgtgtgataaatggaggttgagtatggcggcctgttcacttgatcaggcatttcttttagtgaggcctggggcgtaaccacttgtctgcaccttagagctgccacgcctcttgcagatcgaggcagaggaggctgcgcgggggtcgtggcgtgcggtggcggggtttgatgtcacgttcagtgtgccgaagtcggcatcggtgttgtgggcggttgcggacgcggggacgcaggcgttgattgcgcaggcccatcatgagacggttgtggcggtggttgcattcatggagtgcgaggttgcagccatccgcacgggtgcaactgctggggatggcgcggttgcacaggtcgacgtgacgggtttgatcacttcgattcccgcgccggggacccgcacttgcatacgcatgtggtgatcagcaacaaggcccgcacggtcctggatgggaagtggcggagtttggatgggcgttcgatgcatgccgcggtcttggcgctgtcggagctgcacgaggccgtgttcgccgatcacatgacccgcacgttcggtgtgacgtaggagccgcgggagatgggccaggaccggaacccgtcgtgggcgatcaccgacgtccccgaacagctggtggcagagttctcgacccgcgcccggcacatcaacgaggcgaccgacgcgctggttgctgactacgtggcccagcacgggaagcgcccttcgccggcgaccatcatgaaactgcgcgcccaggccacgctcgcgacccgtccggagaagcaggtccgctcacttgcggagctaacagccgagtggcgcactcgtgtcagccagcagctcggtgtggatgccaccgtgtgggcgcggaccgtcacgggtggggagcggcagttgctgttgcgggctggtgatgtgccgttggatctgatcgaggggtggggcggtctgtagtcgagatggtcggtgagaagcgttcgacgtggcggtgctggaacctgatggccgaagtcgcctgccagactgtggggtggcgtttcgccaccgttgaggaccgcgaagtcatcaccgcgatggttgccgacgcagcggaacaggcgtccttacgcctgaccccacccgagctagcgaccagcccggcgaagttccgccgcccggacggcactagcgtatttcgtccgaagcactccacggtgttctcctccgacagcctcctggccgcagaggaccacctcctgcaacgggcccgcaccgcgaccggtccgactatcgacctgaccaccgtggggaccatcacgagcaaggcggacagcgagggtcgggtgctcggtcccgatcaggccgcagctttggcgtcggtcgcggtcccgggccgggtggtggatgtgttggtggggccggcgggggctgggaagacggcagcgatgaacgcaccgcgccgggcgtgggagacggagcatggtgccgggtcggtggtggggttggctccgtcggcggtggcggcccaggtgctggccgatgatctgaggattgccacggagaacacggcgaagtggtggaccacccaccaacacaccggcgtcactttcaaggctggtcagctggtcatcatcgacgaagcttccctcgctgagaccctctctttgaatcggatcacgctggctgctgaggaggcggggacgaaggtgctgctggttggcgactatgcccagctcccgtccgtcgatgccggtggtgcgttcagcctgttgatccacgaccgccacgatgcccccgagctggtcgatgtccaccgcttcacccacgcctgggagaagaccgcatccctggagctgcggcacggccgcaccccggtcatcgacacctacctggcacaggatcgcatccacgacggagacgccgaggccgtgaccgctgccgcttacaccgcctggcgccacgaccggcagcaggggttggcgtcagtactgatcgccgaaacccgcgagaacgtcaccgccctcaacatccacacccgcgctgacctcatcctggacagcacgttgaagcctggccccgaaatcaccctgtccgacgggtccatggcaggcgtgggtgacacgatcatcacccgccgtaacgaccggcggctgcggaaccggcacggctgggtccacaacggccaaacctggaccatcactgccgtgcgtgacgatgggtcggtcacgatccgcccacccagtgcccggttcggcaacagcatcgtcctacccgccgactacgtggctgagcacgtcgacctcggctacgccgtcaccgctcaccgcgcccaaagcatcacaccgacaccgcccacgtcctcgtcgaacccacggcgacgcgggaaacctgtatgtggctatgacgcgcgggcgcgaatcgaaccgggcctacgtcatcctcgaccgtgccgacgaccacgccgccggcgccgtgtgccgtgtgaactcggtcgacagccccggacgctgggtcgcgcggtccgtgatgagttcgtcgacgtcggcagcggaggtgaccaggcgtgcgtggccggtacggagcagctcgtgcgcaccacggctggtgacaggccccggcaccgcaccgacctggcgtccgagctggtgggcctcggacgctacccgaagcgcccccgatcgcgcgccggcctcaacgaccaccgttgctgctgacattgcctccaagcagtcgggagcgggctaggagccgatgccgcgtcgacacggatccgggaggaagctcgctggccagcgcactcacatcacccacccggtccagcaagtcacggtggccgctcgggtcggggcggttcacgccaccgccaacaccgcacggtgcacagcagcctcgacaccattaagcgtcaccagccaccagtacacgctcacggttcgcgaggtcgccagccagctcggcggcgacatgctccccatacgcggaagccgcccgagaacccgtgaccgtcaccagatcgttccacggtcgcgccaagaacgacgccgcgccccgcacgaacagaataaacggagcgcggtcgcccagatcatccagcgcctgtggccagtgcgcgtcacccggaatcagagtggcgatcccgctctcctcgaccatgcgcagccgctgggcgagcccatccagcctgcccggtgaggtgaggtggtcacgccacacctgaccatcaactcgactcagaccaggcacggtggtcgtgtcggtgtcaagcagcccgagcgtctcaacggcacccaggcggcgcatcagcccgcccgtgacgggatcatcaggctccgccaacagcgccagcaccacccgggcacgacgttcatcaacaccaagcccagcaacaccagacatgacggctcctcctcgaacagacttcgccgaacaggtgcgccaacgcagcccgcaggtgtcgcgacgtcctcagcccgtggaggctggcgaacgcggtaacattcgacagtcgcacggttcggcagctcgacacagcagcgtgctggtgttgctttggaggagtccacgggcctcgccccccacaacggtgacttcaatcgacattgtcgttgttggtgatcgaagtgtcaccgcagctgcgaacgatagtcttgatctggacaacgatttcgatgcggaggaaagcacatgaggctcacacgcttcaaggtcgagaaccataggcggttggccgacctcgacattgaggtgcgcgaccaccttgtgctggttggagccaacgacgttgggaagtcctcgctgctccggtgcctcgatttgctgctcggggcgagtacggcgcagctctactcccgtatttcggccgacgatttccgagcccccgaccaaccgttcgtgattgaagggactctcgcggacttcaccgatgtcgacaaggctctgtttcccgatgagatccacgtcgacccgaacacgaatccttcgcgtctggtgattaggctcacggcgactgtggatgagaacgagacggtggtgatcagtcgttcggcccccgagggcggaacaggacgccagctctcacgggatcaggtgcttggcctgggatggaagttcctcagcgcaaccgcccagacccgcgaccttcgggaagaccgaaagtcggcactcgacgacatccttcaagctgtcgacttgggtgaagagaaggccgcgttcgaagccatcgcaaagagcctgacgaccaccttgggtagctctaaggtgcttgaaggcctccgaggttcacttgctgaccagctgtcgaaggctctgccggacaaggtggcacaggatgacttggcgttcgtgcctggagctgctgccgacaatgacgtcctcagcgacgtgcggctgcaagtcagcaagcaaggcgtggcacacgatctttccgaacagtcagacggcacgcgagcgctctacgcgatcgccctctacgatctgatgagcgtcggcgctaacatggtggggattgacgagcccgagatccatctacacccgagcagtcagcgaagcctcgcgcgcctcctgcggtcgaacgccaaccagaaggtcatcgctacgcattctgccgacatcgtaggagccttcgatccagattctattgtcgttgtgcggggcggaggcgaagccgttcaacccaaggctggattcctgtcggacgatgagcgaatggcagtacgcctgtgggtgagggatcggctcgaaccactcactgcacgtcgtgtcgttgtcgtggaaggcatctcagatcggatcatcctggagcacctggccgacctcaccgaccgaaatctcgaccggctcggcgtgtccttgattgaggctggcgggtgtggcgacatggggccgctcgacaagctctttggtgccaatggcttccgtgtatccatgtcgcaactcatcgatgcagatgcagaagaggcattggcaaagaaactgggagtcgaagttgctgaccttgcaggccgatccgtctgggtctcgcgaagcgacctcgaagacgagtacgttcgtgcgctcggctcggacgccgtgtggacagcactccagtcaaatggccacttctcgaagaatgaacttggcaactgcgcagcaagtgggccggctggcacgcgtaccgagatagatgttgctgccttctgtcgacgaaaggcgtacaaagtaaatgccgcgctatcagtcctgccgctcttcacggcggcgaatgccacgcaggtgtcgtctatcgagagtctactcgaagagatcgtggcgtagatggtcagcccgactcagaagcagattgacattagggacacgcgggttctcgatcttcttgtcgttgctcctgcgggatgcggcaagacggaagcgcttgcattacgaatccaaggacttcttcaccgcggcgatgtgactgccccaaagaagatcttggtgacaacattctcgaaccgagcccgcgacaacatcagagaacgattggggtcctacctgacgccttcggtaatgcgcgaccgcgttactgttgtgaactttcatggactggcagcccggttgatcagagcgcacggaaatgttatcggcctaagtgaggaactacgccttccggagaacgactgggttggcgagcaactccgccaacgcaacaccccctggaatgaccgaggagcgatccagaatgcgcttcgtgagacaaagcaacaacctttcagcgacgcagcggtcgaagctgaacttgaacgactcggaaatgtcactgcacttgaactggaacggctcagaaaggaagaaggacgcctcacctatgatgatctgccaagacttgccgagctgattctcggttacgagagcgtcgcggacctctacgcgacacacttcggcgctgtcgtggttgacgaattccaagatctgactccccagcaactccgaatcgtaaacagaatcggttacaagcgcacaacctatggcggtgaccttgtgcaggggatctatggttttgcaggagcgcagccactggcaattgatcgggacatacgtgccgagtgcacctgcgtgatcgagttctctgagtcgcatcgatcctcaccggcagttctcaggacggtcaacgcccttatcccgatcacgtcgggacaggtactcaccgcagccaaccccgactcctggccttcgggcgggctcaccgggacgatcgtgcaccaatcggcggaatcggaagctaagtgtatcgtgaaaattgcgcgagccatcctcggcagggctcccgggcatcggattggagtgttatcccgaacagcgccgcgtcgccgattcgttgacgcagccttcgccgcggcaacagatatacctcactacaggtgggatgacggcgtgttggacacagatactgccaaactcgtaaaggcaatgctcgcgaggtttgatgtcgccgcctacactgccgcgcccgacaaagtaactttccttcggatggcggttgactttgactcgatcactgatgtcgacacgcgcaagagcatggcggatgctctcggttgggtacaagatctgctgtctaaagcggtgaagccagagagcatccgtggacgcatcaaggttggcgattcagcgaccctcatgactagccctggagtccatctactgagcggacacgtcggcaaagggcaacagttcgactgggtgattgtcgtaggccttgaaaagggctccattccgttcactatggctgacacatcagacgacgagatcgctgaggaagcacgagtgctttccgtgatgatctcacgcgctcggcacggcgtcattcttagccgagccaactcggttcggacgaacggggggcaccccatgagtcgaactccatcccagttcctcgagtggattgccactgccaatccactcgatgcgactgggatcatcgagtggttcaaagctgcggactggcgtgtaatcagtgagagatgaccaacgttctttggagagaagtgcgctgtccttgatgatgatccacctccgacccgcgcaaccttgggcgccggactcaccaggttgcagatcggatcagactggtaagcaagcgcccgtaaacctcgacttccctgaacacgggcccaggtcctattgaccccgttcagagagcacgagttcgtccagtcgcgctgcgcacccgatcccacgtcgtcagaaggtgagcggtagccagccagggtcatttacaaagcgctcagcgcgatctacagtagatagtaaggcaggttctcgtctcttgcgggtccatcgggacggcctacgggcgctcttccacgtactgtttcctcgacggagtagcacgtgtgacgagagagcccgatcatgttccgaaccatctggacgctcagcattcatgtcgatgactgtcttccagcactacatgccgagcaaccggctgctggcagctacgcgaactcggcgaggtgtgaagtggggtgtctcggcaatgctcatcggcgtcccgtatctcgccatcgccaacgtgttcaactaccctgactgaccgttctgtggtgacgtgcaacggggtatcgatgttggtgtgcgcgaggacgttggttgtgggctcgttgtcgggtgcgtaggcggcgttctcgtcgttgtcaatagtgatgcgggtggatagggcacggttgaggattcgccgctcggctggcacgtacgttctcgactgtggccacggttagagcgaggtgtgctccaacggtgtcaacccctgggccaatgtgttgatgaggtcacggtgacgagtatgtggtcatggccgcacactccagattgatccggcaggcttccagggtggtgaacctcgttgaggggtccagctaagtacctaaggtcatggccaagcacgatcgcattcgctttgccgtgtgctctctttcggatcatcccggggagcacacaagatcgcccgaacaatggcgatcttgtgtacagtgactttgctagagatgttttcccaggaccgacagtgactgccagtgcgatgttcgaggtagtggtgaaactacgggtgtacaagatctgggtggccgtaaacgaggttgcctcttgggctcaggtcctgcctgacggaacccccctatctgagccctggccatgacgggtatgccttagtcaacgtggctgaagtgtcctgatatcgcagcatcagtgactagtttggtaactgtaatgccgccgcacccgttttacttactttcgatagaaagcgggtactctgtgcactttgcagggtttttgccttcgttgcttcccgtgcgacttactgtgtcttcttccttggggaggtgtaggggagggtagaatgttcgtggactagatcaacttaaccaacttacgggttgtaggttaacacctatctgtcaaccttgacactgtaatcccattgttcagcaggcacactgtcatacatctcactatctgtaaatgcagagcctgtggtttcaccaccaaagcctaactgccttaaatgtgcaatcccgttctgtgctccctccaaatcgatccgctccagtgtttcatcagcttcagaagcatagaggaacgtcacgctaacctacgatttggttctgggttgaatttttaggcgatctgatctgaagtttcgcgcgcctgcatagcccgatccgcaatctcgtccagcccgctgattatgtgatgcagctcacaagtagttagtaacaggacctgctccgcggcctggcctctatcggtgatcagcatgtgtccacggcatcttatctaccacgatgtcgcaatagttgcactgattctgacggcaccgccaacattcggtaagtgtaggataggacaagccttgagagtgtggatggaatgtgccaactctctcagtcctcaaagcatcagtggctagatcaacaaacatcgtaaacaggttgttctctcttatagcgatgtgtctatcgaagcagatgaacgagtcatctgccaggtatgaatgattgccatcactagtaacctctgcgtacggcagcaagacgttactgatgtttgagattaggagatccccaaaaatagatactcggagcgaaatagtatctatacctacgatgatgccgtgaacactactggtttctcaagcaaccagatccgcacatttaaaccatgtgaaacgtccggtaaacattctgctgtaagtcacccaggtgaccccttggagaaagttatttcagggctatggggctcgggggtgcgagaggattgttcgttgctcatttcggattatctttcagagatgagcaaccgcaatcggcattgaccagaagcgggtaaccggttgaccctagacagacttatgtttggtattcgtcaagcccccatcgggcgactggaacctgatcaattagatgatttgattgctattcttagaagaatagtttcctagattttatagcacttcccctaaacgtctaagtatgccctaaatcgtagctctaatgcagatgggcgggcgaggacgttccgggaagcatcgtcaagagtgtcgatgtcgcctgctctagctaagactcgctgcctaggaaaatcctgaacccaagtggctcggtatttgggggtgtagttcctggcgctatcggtgatgtccatagcagtcttggcggcggacgtgttcgttaagtcaataggactccagctggttttgtactcgtaatcttcaagatcaacatcgattcttagctcagtattgaggatctcgatcatgaaactcgaatcagagggaaaacttaactatcatatgcaatatcttcttaagaagagcgcttgccgactacgttatcaagcgatcccacgagcaccaatctggtatcggtaaaagtgttcgcttttctcggcggaaaatccccaaaatgcttggatatttttcttgacggatgaacttggagaagcgctgttctaatgcggcgtcacgccagacagtgtgcgcccggcatcgcccaagcctgagtgtccgaaacatgcttgatgcgtgtgaagcgttcctgcgaccaaggctcagcttgctggggatgctctaattacttctgctgctcgatagtatgcgtcctaggatagacgttgacttgagttga

SEQ ID NO: 64 - DNA, 2854 bp, Propionibacterium acnes
tcttgttgagcttcaaagccatgaaatcttcggtctgcttcttaatgccagtctctgccgggaatcgctcgatggaagatgcgccgtagaagcctacgatgccatcggtgtgatcgagaatgtattgcgcatcctcgggattggcgatggggccgccatggcataggcataggatgtcgggattgacggatttggcggcgtcggcgagttcctgaaccttgacagcagcatcctcgatagtgagtgctgtttttgcaccaatggttccggaggttgtcagacccatgtgggggacgaggatgtcagagcccgcccgggccatatccttggcctggtcaacgtcgaaaacatagggtgaggtgaggagatcaagattgtgggcaattttgatcatgtcgatctccaaaccgtaccccatgccagtttcctcgaggtttgcgcggaatgtgccatcgatgagaccaacagtagggaaattctgcactccggcgaaccccgcggctttgatctgggttaggactggggcatcactctgaagggatcagtgccattaactccggcaagaactggggtgtgcttgacgacgggcagtacctcgcgcgccatgtccatggcgatctcattggcatcgccgtaagcgagaagccctgagagggagccgcgacctgccatccggaaacgtcctgagttatagatgacgagcagatcgataccgccggcttccgcggatttaaccgtaatcccggtgcctgcgccgccgcccaccaaggggattccgttggcgacttgtccgcggaactttttcaggatttcagtgcggggcatgatgctattcctttccgattagttatggatgatgagctcgtgaagagcccgcgccattgcttcgccaaaaccagaatcattgatattttgttttcgctcagtcacagtgatgtcggtatcctttattccctctcgaatggcgttgaacaaagcgtcatcggcttctggatcatagaaatcttcacctggggtatctattcctgcgacccccagagtaggaatgaaagcttgagccgggccgcgcgcagcggccgcctttatggcgattctgtgaccaagctcggccatttcggtgttgctcgtttgagcgtcaccgctggattgtggatatgcaacgtgcgagaggaatagcgctccggaatagtgtcgacagggccgaaattgaccatgtcaagcgcgccaagactgatgacttcgggtattccaaggtctgctgcggcttccatccggcggggtcctgccgagagaactcctccgcagaggtcgtcggcaagctcggtagtcgtcaggtcacatattcccgcgagtagcccagacgatgcgagcttttctatcgccttcccctcccggaatcagttgcgtggaagacgaggacctcgtacccaaggtctgtcaaggtcttgcgagcttcgtcagcagccggcgttgtcaatccgaacatcgtcaggccgacgaccggtttgttgtgagcggggttgctgacggttctaacgtcttcatactccttggccatggctgtgatagcggcggctgcattggcgaagaccatgagcgacacggaattgatgccggccacgtcaacgacggagtacataagtgtgacgtcggtttgtcccacgtaggggctgacatctccggaagccatcgtggaaaccaggagcttggggaatccaatcggcaatgtctgcatgaccgaagccgctacggatgatccacctgatccgccgagggacaggagaccgtggattttcccctcttcggcaagcttggatgcaataatcgaagcgccacggcccatgacatccatcatttcgccacggttatgacgtgttcggatgtcacttggcgactcgcctgcggcacgaatgacctcatcggacgtgtagtcggctatacggctgttggagaatgagccaacatcgatgatgactacctggctgccgttggtaagaatgcggtgacgaagccagtcgaactcgtctcccttggtatccaaagttccgagcaaagctattgcggccatgaacactccttcgtgatcgtgtcatcatgaccgtagttcggtgattctgcctacaccatgccgtttgagacgaattggcctgtacgttgtatcgctggttgtgaagaagggcaatacttcaggtgtggttgtcaaggttgatcctgcaagtctgagccggatgctgggggagtggagccagcccggagaagcgcttccggaagcgttggcggacgcattgctggatctcattgacgctggttttctgcccgctggtgcggttcttccaccccaacgagcatgcgccgcgacactgcaagtatctcggcaaaccgtggcggaggcatttgggattcttgaagccgcaggccacattgcggcgttggttgggtcagggacgcgggttagatcaggccgcgctgcagtgagtactgatggcaggttgttctcgttcagcgaggctgcacctggcctgatcgacctgtcaacgggggcgctacctgcgtcagaggtggtgcgaagagtgcggctagaagaccacgtcgacttggatgagtatttcgataccgacggatatttcccggctggactacctatattgcgtgcagccatcgcggaacggctcactcgagatggagttcccacagtcccgcagcagatcgttgttaccaacggcgctcagcatgcgagttatcttgcctctcagctcctggtctcggctggtgacaccgtgttggtggaggagccgacatatcggggtgagctcgcagagctgcgactgatgggcgcccgtgtgaagagtgtccc

SEQ ID NO: 65 - DNA, 728 bp, Propionibacterium acnes
ggttgtctggctcttcgggcctgaggtggggcagctagtcggggcccggtgcggtgaggggtcggggttattcggcaggatcagcagcgcccaaactcgctgctccaagaagaccccgactgtgtgtgagcctaccaactactgccctcgttgtgatgccctaacctgcccggtctgtacgtgaccgacgtcgagcgcggacccgatacgattatggtgggggtaaagttagctccgggcgaggggttctgccccgactgcggtgtgctcgcgtctccccatggccgccgccgggtcctgcacgatgtttcttcggcagtatggcggtcgtgatcgggtggtgtacacgcacgtggcgctgcctcgaagccttgtgtagcaagggctctttcacggaacaagatcctggaatcgccgtactgtgggcggtgttgacccgccgtgccactcgatgggccgtggggcagctgcgccgagaacgcgtctcagtgctgggactcgcacgccaagctcagggcgactggaagactgtctggcgggcggtcaacccggtcttagaggaggcggacgctgacccagtccgctttgcggggatgcggcacctgggggggtgagcacgtctggcacgacaagaacccacgaacccggggaccgaagatgctcaccggcatagctgtcttcacgcacaccgacgacgtcccacgggcccggctgttagacctgaccct

SEQ ID NO: 66 - DNA, 727 bp, Propionibacterium acnes
agggtcaggtctaacagccgggcccgtgggacgtcgtcggtgtgcgtgaagacagctatgccggtgagcatcttcggtccccgggttcgtgggttcttgtcgtgccagacgtgctcacccccccaggtgccgcatccccgcaaagcggactgggtcagcgtccgcctcctctaagaccgggttgaccgcccgccagacagtcttccagtcgccctgagcttggcgtgcgagtcccagcactgagacgcgttctcggcgcagctgccccacggcccatcgagtggcacggcgggtcaacaccgcccacagtacggcgattccaggatcttgttccgtgaaagagcccttgctacacaaggcttcgaggcagcgccacgtgcgtgtacaccacccgatcacgaccgccatactgccgaagaaacatcgtgcaggacccggcggcggccatggggagacgcgagcacaccgcagtcggggcagaacccctcgcccggagctaactttacccccaccataatcgtatcgggtccgcgctcgacgtcggtcacgtacagaccgggcaggttagggcatcacaacgagggcagtagttggtaggctcacacacagtcggggtcttcttggagcagcgagtttgggcgctgctgatcctgccgaataaccccgacccctcaccgcaccgggccccgactagctgccccacctcaggcccgaagagccagacaac

SEQ ID NO: 67 - DNA, 32951 bp, Propionibacterium acnes
ggtggtgccgaagaagaaggaatggccccaccaatctgctggtcggtagaagtacggggtttgagccagtcgagtagtttcataatctgctccttgcaaggtattgtgaaggatatgaaatctcttacccctcatttgcttctctgctcttttttcacaagcattgctcctgccttaggagaaggatttcgcaacaaacgtgtggctttcattccgacagcagcagcccacgaggagtacacagcctacgtggattcagcacgctcatcatggaaagaacttggcagcaatatcaccgatgtggatattgccagaatgcctctaagaacagcgaccgaggcgcttgagcaagccgagataatctatctttcaggagggaactccttctacctcctcgattgcctacgctcaacagaaatcgaccagattattcgagggcgtctggccgaaggggcgattctagttggtgaatcagctggagctatagtttgtagcccaaatatcgcctacattcagccaatggatcgtgtccctgacaactacagccaggctgactacaccggactgaacttagtggacttcttcccggtacctcactacctcgcccctccatttgtgaagagttccaaggaagtagtcgcccagcacgctagcctcccactcgagctcatgaacaacgcagaagcggtaatagtagagggtccccaaaggacaaagatctcatcagagcaccagtagtcctcgtgagtcgtacaccgacgtgcccgtgtggctgccaccgcctcggatagcgcggtcgagggccatgatggtggcgaccacctcgtcgatcttctcggtggacttttgcttgtcgggtttgatgtttcctgccgggtcggtgcggacgtgaatgttgtcgaccatccaggacagcactgggtgcctgccgtgagcgagcctaccttctagtgcgagtctcatgagctccttggacggtgggctcatgtctttgaagccttgcccgaagggcacgacggtgaacccggcatcgtcaaggttttggctcatctggactgcgccccacctgtcgaaggcgatctcgcggatatcgaagcgtgtcccgagttgctcgatgtggcgttcgacgtgggcgtattggacgacgttgccctccgtggtctctaataagccctgttggtgccacaggtcgtagggcacatgataacgcgccacccgcaacgccaggttgtcctccggtatccagaaccacggggcgatccggtacttcttcgtccccgtagggtgggaagatgaggacgaaggcggtaatatccgtcgtagaggcaagatccagcccgccgtagcagcgtcttccttccagctcgtccaggtttaccgggtcggctcccgcgtcccagatgtgcatgggcatccaccgcaccgactgcttgacccactggttcaacctgagctgccggaacgtgttctcctcggcagggttctgccgggccgagttgcacgccgcgcgcaccttgtcgatcggcaccgtcacgcccagtgaggggttggctttgcgccacacggcctcatcggtccaatcatcatccgcgtcggccccgtagatcaccgcatagaacgtcggatcatacttcttgcccgcgaggatgtcctggactttctggtgctgctcatagcaaatcgaatgcgtatcagttccggcggtggtgatcaggaaatacagcggctaggtgcgtgcgtcgcccgaacccttggtcatgacgtcgaacagggctcggttgggttgggtgtgaagctcgtcgaagaccacgccggagatgtcgaacccgtgcttgaagtaggcctctgcggagaggacttggtagaaggagttggtgggcttgtagatgattcgcttctgcgaagagaggatcttcacccgcttcgacagggctggtgattggcgcaccatatcggcggcgacttcgaacacgatcgaggcctgccgccggtcggccgcacacccgtagacttcggcacgctcctcaccatccccacacgtcagcagcagggcgacggcggcggcaagctctgatttgccctgcttcttggggatctcgacataggcggtagtgaactggcggtagccgtcggctttgacggtgccgaacaggtcacggatgatttgttcctgccagtcgatgagctggaagggctgtcctgaccagcggcccttggtgtgtttcaaggcttggatgaacgcgaccgcgaagtcggctttccgcttgtcataggtggagcctgcggccatgaaccgggtcggcgtgtaggtgtcgagagtgcgcatcacgcccgtcaggctccttcctgtgctggttagttggtgtgggcgaaggcccaggcgatggcgtggccggcgtcagcgaacagttcgtcagcctcggcgaccaggtcgagttcgcattcactgaagcctcgggcgtcctgtccccagccggagatcggctgctcggcgagcttgtagacgcgggcgtcgtttccgatccggcctttgcccaagtgccggtaggccgaggcgaggacgaagtccccgtaggcgatcaccgtgccgtagctgtcggtcgccatctgcagctgctccatcgtggtcttttcgttgttcatgaccttctccttcttgccttgttcggtcatgtacatacagccataggtgcgcgctcttatccagtcgtaaaagccctagtcagcccactatttttgaggaatctttgaggggcgacgggcacggaaacggcccctgattgggtgggtacccacggtggcttggggtcagtcgatggccaggtgccaggcggggatcatgcggcgttccccggtgatcgggtctgggtagcggtcgttgacttgggtcatgcctcgcagggttgcccctgcctgggtgaggttccagatgatcgtggtcaggccggtctggttcgcgctgatcgtgaactcgccgatgctgtgctccttgagttcgtcgaggatgctgggcacgtctgagtcgtagagaccttcggcgaagtcgagcagctcgttgcccgcccgctggctgttcatgtagacggtgagcaggctcgtggacgaggtttgggtgcgggtcgcgatcttgctggtcgaggtcgtcaattgtgttcatcgcgggtgtccttgtgggtgggtggggtgcgccaggcggcgttgccgtccaagtgtttgagcaaggtgcggcggacgggtttggtgtcgtcgccgatcagaccgaggcgcagcagccagcagcgcatcgcatatttgtcgttcccgcccgtttcggcaggtttggctgaggctcttgtggcggttttggcgtggtcgatgatccgggcgatcagcaccgtggtggcctccactacctgcgggtcgggcgctacgtcgaaccaggggaactcgaccgtcccggcctcggcgtcgatgctcatcggggttgcggggatctggagtgctttggcgatgagctctcctttcgctgctagcgtcgcctccaccttccctttcgtggtgtcctcccaaccggtggtggggaacgccaacgtcaaccccaactcgcctggctcgtcggtggtgtccgtcgggaatccggcctgcgcggccgcctcgaccagcccggccacgtcggtgtcctcgggcagatgcagcagccagtcacgatccaacatggcctcgccaatctggtaggcaaacgttggggttcccagatactcgacggtcgctcgcagctgggtggcgagaaaagcggcgagttgcttgcggcctttgcgctgcttggtgaacttgagtgtcgtcatgaccggcctcctttgcgtgttcccctggtcggagtggttttcggtcatgtacatacacgctctatcccgaccagatagcaagtccggacggccacctatttcttgcctcgatccacggccttcaccacatccaggtaggccaactgttggccgtcgcgcaggcaggtgatacctgcggcgtccccggtggcgtcggcgtagcggcgcagaatgactgaggcgtatttctcgtcgagctccatgcagtaagcgatccggttggtggcctcacacgccatgagcgtggagccagagccggcgaacgtgtcgagcacgatcgcattcgcctgggtggagtttccaatcggatacgccaacagatccagcggcttcgaggtcggatgatcagcattcctgcgaggcttatcaaaccgccagacggtggtttgtttccgatccgcgtaccacgtgtgcttgcccgtcttcacccagccgtagagaacgggctcgtgttgccactgatacggggaacgacccagcaccagggagtccttgacccagatgcaacaccccgacagcttgaagcccgcgtcttgaaaggcgcgccggaagttcagaccttcggtatcggcgtggaacacgtacgcggacgcgcccttctcacacacgcccgccatctgagtgaacgctgcgagcaggaactcgtagaacccgtccgcgctcatcttgtcgttcttgatcgacaagccgtcagacgattcgaaggcgacgttgtatggcgggtccgtgagcaccaagttggccttcttgccatccatcaacagctcgatgtcgcccgcgttggtggcgtcgccgcacaccagccgatgcctacccaccgtccagatatcaccccgctcgacgaacgcggcagcctccagggcggcggtcagatcgaagtcgtcatcctccacctcgtcctcatccaaggagccgatgagctgggcaatctcatcgtcgtcgaacccagtcagctcagcgtcgaaatcactcgcgtccaggtcggcgatgagcagggcgagcttgtcctggtcccagtcgccactgatcttgttgagcgcgacgttcaaggctttttcgcgggtctcgtccaactcgacgaccacgcagtcgacagtggtttcaccgaggtcttcgaggactttgaggcgctggtggccgccgacgacatggccggtggtcttgttccagatgacaggttcgacgtatccgaactccgtcagcgaccgcttgagcttttcgtagtcggggtcgccgggccggaggtctttgcgcgggttgtagtcggctggcgtgaggtcagcgatgggtagctgctcgatgcgcacggggctccaccgccttccgcaggtcgcgctcaaaacgccaggtttgttcccagcgcggccaatcccggcccatgtgcccgtagaccgcgagatcccggtaacggggtgtgcgcaggttgaggacgtcgatgatccccgccggccgcagcacgaacacgtcacgtgcggcggcggtcaagatgtggtcggcgtactcgccggtgccgagcgtgtccacctcgaacgcgaccggatcagccttcccaatcgcatacgagatgcccacctcgcactcagcggccagcccggcgtcaacgatcgtacgagcgatcaggcgagccatgtaggccgctgaccggtcgaccttggatgggtccttgccggagaacgcgcccccaccatgagacccgagcccgccgtaggtgccgaccatgagcttccggcccgtcagcccggtatcggctcgcggcccgccctcaacgaaccgacccgacggattcacaagaatttcggtgtgctcgtctatgggtaggtaggtctggcaggccggggccacaatcagcgagcgcacctcacgctccaacacggccagatccttgcccgcctcatgctgcaccgagaccacgacggtctcgacggcggcgggggcaccggtgtcgtcataacgcacactcacctgggccttgccgtccgacttgatcccgcagatcgtcccctcgacctgggcagtatcgagacgctcgcagatgcgatgtgccaggacgagcgggagcgggaggcgttcaggggtctcggcggtggcgtaaccgtagaccgtgccctgatcgccagccccctgcaacgcgaacgccgaactatcaccaccgcgtgcctccagcgaggtggtgaccccggcgttgatgtcgctcgattggcggcgcgtccacacgtagatcaggatcccgagcggactgtatccggcacgcgcgagggcggtgcgcacagactcccggatacgcgggcggtggttggtggtgatttcgccggtgacgatgatccgccgaccggctgccatcacctccaccgccacccgtgcggccttgtcgtcgtagaggatgtcgtcgaggatctggtcggcgatctgatcggccaacttgtccggatgaccagcacacacagactcggcagtacgaatcgaacacataagcacactcgcttccacgaatcggaggggaacaagaaagcgtccaccccactagagggtggacgcgaagatcatgaggggcggttaggagcgggcgttgagcagctgctccatcacctcgtcgccgggcgtggtgcccgcgtagtcggtggtgcaggtggcgcgcacgatctcgtaaatctcgtaccaatacacattcgcctgcttcccgaaactctgggacatggcgacaaacgggctggcgatggcggcaccggtggtggggtgcttgccgagcaggccgaacttggagatcgcctgctcgcactgcacataccgggcaaacgcctgcgcatacgcctcaatcaggcgaggcgccacgaattgggaaccgccacgttgatcgagccactgccacgtctcccgatagacgaggtcagcgccaagcggtttgccgtcacgctgaatctccgacagatagtccgatggttcgggcatcgtctccccggcaagcaccgcaccgtcgccaatgtcattacctgcgaagtcgaagggttcgttgagcgggtcttccaggcgggtggcggggcgtccggcggcgagtttctcgcccagcgggccgggcttcgcgcctgcacgcacgcggcgtccgcccctgttggtgccgtctttggccatgggtcgcctccccgccgtagaatcgtcatggtttcggtgctgaagtccacgggaggtgtgagtggttgagtctttaaaactattcgttcggacctacgtgtattgggtagggctcatccttggcttcgcgatagtgcccggttctctgctcttcactgctgaagtcgccccggtgaacactccattgtggcttgcacctttcgccgggctgctgctttttgtcattgatcggccatcaacatgggagccgccgctctggcgagcattactgatccgagtattgggtgcaggatttgcagccaccatgctcatcgcgtttgatgcagttgcttccacccactatggatctcaacactggagtgagacgctcctatctttcggtctcggttggattgtcttcacggtagtggcaggacacatgctcatgagcagctccgcccgatttggcacacctgctcacacgatcagggacgcgatccgtacctacacgacatggataggaatctgcttcgggattttctatatccccgccgcgggactctccgcagctggcactcttttgatggttcttccgctttatggaacgttcctcgccggcctggttcttttgatagttgacccgccacgacgatggccgcaaccgcgagtgaaggcactgtggatacgactcttgtcaagcgtggcagcagcattactacttgttgtcacgaactcgttctatcgcagtactcgcacacacgagattttcgtcggggactggcaggaaaacctggtcttcttcgtgggtgcttgggcactttatgccgcagtggctggggccaggtatcttacgcctggccccagccacgaagcagatgacaaactcagtagatgaattcagctagagcttgacatgctgccctcttggtttcttcgctaggctcaacgcccgagtagccgtatgccccattggaaccgtctgtgagaaggccaacgtatctgtcatccaatgggccatcaatttctgcaaagaacttgtcctttgcggttcctccgtcgcttgcaccaacactctcagagatcgccttgaatcgctgcaatagcgaaactggattgttgtagtagctcctcagcgttcgggacagaaggttggggtcgtcggctcccgagcctttcagcatcgcagccagtttgatcgcatccccgtcgctacacaggtcggagtagttgcagttgttcggcagatcattggggatggtcaaaccttgaagtccgctgtgattcttatagttatccccttggccaacaagagcccttgctattgcaataatgtttgagccgggattcaggtcaacaaccttttgaatcggaccgagcgctgaagctaagtcacccgcccatcccgtccacttatcaggaacgagcgggttcaggttgatgtagcccagggtggtcacgctcatatgcgggatatctactgcaccacctgcggggtccgtccattcttgtcgatcgcagcgaatccacttattcaaggcagagattatctgagacgcttgagtgtcatcttccagccttttcgcgtccgcctcccgatatgcttcagctgccgcggaccactttgcacttcccttgaggtagaccgttgataggtagttgaggacacatcgccaagtcggaactttgacccaagtaacgtagctgccggatgtgatcggatcctctccgaaagcgtagtccttatagaccacgcgcaattcctcgaaccggctctcaagcgcttcgatcagatcgagaaaatctagagcgtcgtaattcactggctgcgcgtggcgcaccgacgaatcggctgacatgcgacccgaatatgccacgcggtcaagatcccatttcccccgatatccactgatttcgtggaactgatcaaatacccagttgtcggggatggggaaaccgagattacctgagaatccggtagacatgtcagaaacgaatgatgctaccgcgtatccagcctgagctatccgggtgcagatgtttcgcgaggcgtagatacccactcggtagccgccgccgaggctttgcgttactgccttgaagtagggcaggatgtggctggtcacctgaggatccgtggcatcgtagtcaacggcgaagtagatcactgtaggtggaacaccaagtcgttgggcagcggtttgggcctctttcgcatgacggtgcccattttcgacactaaagtacttaagttcagttgagtactcttgaaaaattgggaaatacttcagcccatgaccaacgattcgctctagctcgcctgtgcggagcgccttgaaatagtctgcctcagacttactgctttggttgggttcactgagatagcggcctacgatctgataaccatcagccttaagatgtccagcaagctcgtcagtgatctcaaagcgcgtatcgcaagccacacatggccgattggggtcgcctttagaagtgagcaggctcatccatgtggttgggtcgaccaccccggtcactggcaaggcgtgtgcttgctggaactgccacagcgtgttgctgatttcgctgttccacgtgctggtcggcaaaatggagtagccgttgcagaccagactcacagtggctagccatacccactggttagtgccgctactaattgtccgtagtttggagcgagtgcctgcaccaaaattcccggtggcttcggcaggtgtgtatccttcgattgcttggaggacctggattaaagccgtgttcatttcacgcccgtacaagccatcagtgggaatgatccctgtgtagttcttgtacccacggttaatcgcttgctgtgcctgacgaatagctgtcttgccgccgtaggcagagagtaaccggaactgtttcattgacagaagcgccatcattagttcaacatcgaccgttgcgctcgtatcgccaaggccaatatcgactttcatctggcgaatagagtcggccaagtggtcggtaaactcaagagtgatgccaccgtattcggctcgatatcccttgcaccacaaggctccttgaataatcccatgaacattgtcgtagccagaagtttgagtaatgccgtttggccaacgagacttgaatcgagactgtgttccagaaccgaaattgtttgccgtcgctgtaatacccagttcgatttgcagagcgcggatgagtgcgttgattgtatcccagccagtgttaccggtttcttggactgagccgaacccagttttattgccgtaagtcgaattcagccactgctgagttttcagcaccatttgatctgccatgattcctccttcagaaatcagttgttaactcgaggcaggcgaacacctgccacggaggggtccagaacaccggatgagaagctccgagttttttgccctcgcctgtacgtcaccgggaaacccgaatccggacggcaagagcgaaacttcgcgagtttcatccctcactggtactgccgacgaagcccgaagtgttaataccctgtttgattctgggactttgcgcgcagttggccccgcccgctgacctgtccgagcgtcgtagagatcgagaggccccaaccccctcgccagcgccgccaggttcccccgtgtctgccgatcagcaccgaggtgggcatctttgaggtttcgcaacctcggcgcgacgtggcgcgacgtggcgcagatttcagtaggtgtagatcctcggggtctgcctccaccggtcgccgtcgagcgccgactggcgggagtggcacggcttacacaaactgcggaggttggcctggtcatgggtgccgccgtgctccaacgggatgacgtggtggacttcctgcgccggggtgtaccggccagccgcgaggcagtcctcgcacaaggggtgggcggtgatgtaggcggtacgaatcttgcgccagcgggccccataacgtcggttgatcttcgggtcacgctgccacttgcggtagcgctcgtcctccgccttggcgtgggcttcgcagaagcgggcgtgggtgaggttcgggcagccgggctgggaacacggacgggcaggcttgaccggcatcacgcacccctttcccggacacggcaaagccccaaggcacccagccgatgaccgggcttgccctggggcttttcctacttttcaaccacctacatcattgcaggcccgaaaccctaaatgcatccgcagttcttgacaccttttggcggctaggttcacgcggcctgcccatacagcgccgacgccagccgggcgagcgcccgagacttcttctggtaggcgctggtgcgctccacgtagaagtggtcacacaccgtttgcaccgcctcatcctgggtaccgtcgccgaggaagaatgcttcgagcacgaacctgtcgtcgtcggtgagcagctgccaggcgggcaggaaccacgccatgtactcacgcgcctgggcgtaacgggcacggtagatgtcgatccgatccaacgtggccgccacccgcatctccccagcatgcagatccgtgtggcggggcatcccgtcgagtttcgatgaggctggggtggtgacgtcgtcgtaggcggtcttgatctgctcgtcggtggtgtcgatgatctgctccatcacggcgaagtcctgcaatgcgctgatggctgctttgcgggtgtcgaggtatttggtcatcacatgcatgacgactccttcctgcttatggttgtgagttcggtggcgaccgcgtcgatcaatgcggcctgggtcatgtccttcgcctccagcgccttgaggacggcttggtcgagggtgccggtggcggtgaggtgggtgatggtgacaggctcggcctgtccttgtcgatacagccgggcgttggtctgctgatacagctccaagctccaggtcagcgagaaccacacgagcaggtggccaccggactgcagattcaatccgtgcccagcggaagcggggtggatcaggccaagcgggatgtcgccccggttccacgcctcgatgtccgccgacgtcttcagttcgcgggcttgtgggaagcgacgctggatgcgttcgcggtcgtgtcggtaccagtaggcgacgaggacggtttggccgttggcggcctcgatgatgtcttcgagggcatcgagtttcgccccatgcacctcgaccgtatcgccgtgctcgtcgtagatcgcacccgaggcgagctgcagcagcttgcccgacagcgcggctgcgttcgccgcatccaccacctgcccatccagatcaaccaccaggtcggccttgagctgctcatacacagctcgttctccggctccgagcaccacgggcgtggtcgtcaccgtcagatcaggcagcgtgaggtggtcggtggtgcgcattgacaacgtcatgtcggcgatagcgtcgtagatttcctcctcagcgcctgccctcggcttgtacgtgaacacctgcatcccgttgcgcttatccggcaggaaccacttgtcgcggtagcgggtgatgaatctgccgaggcgttggccgccgtcgaggagccggaattgcgcccagatgtccatgagcccgttggaggcgggggtgccggtcaggccgacccagcgcttcacgtgtgggcgcattttcaccaacgccgtgaaccgcttcgcacggtggttcttgaagctggagagttcgtcgatgacgaccatgtcgaacggccagctatcgccgtactgtctgacgagccaggggatgttttcccggttgatgacggtcaccatcgccgacttggccagcgcgtcgagccggtcagctttggtgccgaccgcgaccgccaccgatagaccttggaggtggtcccacttggctacttctgctggccaggtgtcgcgggcgacccggagtggcgcgacgacgagcacccggctgacggtgaagtagtcgagcagcagctgccagattgccgtcagggtgatgacactcttgccgagtcccatgcccaggaggatcgccgcttcgtggtggtcgaggatgaaccgcgtggcggtctgctggtagttatgcggccggtagcgcatcaagcaccttcttgatgccgtccaccgagtcaacgaccagcgcggtgaagccgtgggcggccagttggctcatccggcggcgttggatcggccgaggcttcttgccgggggctttcacttcgacgaagacgacctggcctcccatcaggcatagccggtcaggtacgcccgtggttccagggcagacaagcttccagcacaagccgccggatgcctcaacggccttcttgagctgggcttcaatgtggtgttcgttcatggtcactccttgagtggtttcccacgggggtgacgactggtgacgggtggatctggacttttctaaaggagatatttttgtggccttagtaatagttcaatactgatcgtcaccggtcgtcaccctcatcgggtttagctgttgaattcgctggtcagagccagtccgtagacgtacatgccatgcttggacttgcgtcgttcaaacccggattgttcgagagtggcgttgaagtcggccatcggccgagcccacccgctggtggattgcgcccacgctcggtactcctggtacaggtcaccggcgcgttcggatagggacgggtccacctcgcagcgggcgtcgaggaattgggcgaaccagttgttctcttcccgatatgcgcttgaggcagcgaccacttgggcgggtggggtgagctggtagtcctcggcgtggatgagccgcgagccttccatgatccatgcaagtaccgctccgccggcggtctcgtagaggtggtcggcgtagttcttcacatcggagctactctcgatgaccgcgttgaacgggatcacgatgagcctgcgccagatgcccgcatccatcgcgcccaccctgggcaggtgattcgtgtagaggatgagcgtgtgggatggggtgaacgcgaacggtgccttgtatttcttctccgcgtagatctggtcggtggaggcgagttgcttgaccgtggaggtggataggcgcacgccttcctcggactctgcggcgatgatgagccgtttgcctttcgcttcggcaagctcaggtttgacgttccggttcccgccaatggtgagcacgtcggcggacatgttgcccgcatacgtgccaagcactctcgcgatagtgttccagaacgtggacttgccgttgcggccgtccccgtaggcgatcacgagggcttcgaccatgaccgtcccgatcgctgccagcccgacgatccgctgcacatacccgatcagctcccggtcggattggaagaacacgttgagcgcccggttccagatttctgcgcccgtgtcggtggggtcgagcgcggtttgtttcgtgatcagatccagcgggttatggtcacgtcgggtgccgtcacgcacatcccacgtgccgccaggcgtgttgaggagatacgggtcagcgtccagccgggctggggtggtcagcaacatcgggtgtgcttccctcaggcaggaggtgatcgcccgggactcgcggcgtttcaacacgaacgcctcgtatgccttcgcgtcctcaaatgcccggtaggcggcccgctgcggtgaggtgaaaccgccgagtgctttcgctttcgacgatgcggctgcgagcaccgcgttcgcgcccgtcaccatgagctcgtcgcgggctttctccagcagatgcccggcctcggctagttgccggtcggtcagttcctgggcgatgccttgcgcagcaggcgcagactcagaccacacaccgccttcgtagacgagccagtccgtggcctccgtaaacgccagacgcgacgagtattctgcggtgagcatggatgcctgcccgacatcggtgaagtcctccggccgcaggctcgtcagctccgcgtaggcttccggcgacagataacccggctgcgcctcgactttggcggcgaaccggcaggcgctttgccagatcgactccaactcgtgatccgacaggggcggttcacacagggacgctttccggtcgaacaggtcacgagcttgggcggtctgcccgtaacggatcaggacgcgtccggcgaagcgggagagggtggcgttgcgggagccttccccgatcacctgcgtggaagcgtcgaacgcggcgaacacgtcgatctcgtcggcctcatccagccaggcgtcgagcagctttgtgccgttgtggatggtggtttcggggttggtggtgccgtagatgaaccgtccggcatccaacgcctgcgggtcgaagaacccgaaccgtccagcgaggcggcgcttcaaccccgcataggtgtcggcgtcggtgaccgggctgattgggaagtagacgtggaagcgaggcctggccgacagcgtccttttcggcttctggtggttacggctggtggcggtcatgaactcaacccccgccatcagctcggccaggtcatctggggtgatccactcgtcggggttgtcggtgtggtcgttgtcgatatccatcacgacacagtccgaggagatgaagctcgccgaggagcgccggtcgccggtgtaggtggcggcgacgtgatccaaccacgccacctgctccagcgaggtttggtcggtgatgtggtggtggttcgggtaatggttattgtgcgggttgccgctactcgtggcggcgcacaaggtgaacggagtcatgcgggatgcacctcctggaagtcggcgtcgaagaagcggatcgggatatccatctgatgggcccagtcgatctccgcccgcatccccgggctgaccctgccgatataggcccacagctgctcgcatttcgacagcaggatgcggttgaaaaacatcgccagctcccgggcatccgggtcggtgtcatccatgaactgcggataatgcaaatgcggagccaacgggatctgacgagcctttaccgcaaacgcacaaaaccggcgggcaagctccacgttggctgctatgtcacccgagtacggggagcagatgtagaccaatgggcggtagccgtattcggcgagctggatttctttcagcgcctggtagcaggtcgggtcggggtatccgtcggcgttgcgcagcggaatacccacatcgatggtggcgatcatcaggcgccctgaccttcacgttcgatcaccggcagcaggccacgggtgttcttcaacaggtcgtagatgaacaggcgacccttctgcgtccagtacatgtgggtgcgggtcttgccctcgtcgtactcgtgcgtcttggactgcgtgtagccctgctcggcaaatttcgcgtagaggaaccagcgtccggactggtggaactgcacctgctcctcgcgcagaatctggttaagcttcttcgccgacagcccgtagtccttggcgatctctgtggcggtgatcagtgagggcgatgccagcacgatgtcgtagtacgacaccttcggtgccgcctccaacaaagcttgctcggcggcgagccgcttggcacgttcagcccggagcgtggtgatcgcccgctccagaaactcgtcgtcagcgagcagttcgtcgatggcgtagataccatgtcggcggatcgtcggcagaacctcgtcgaacacccacgtctcgaacttctgggcggcaggaagtttggaagtgacgatcagccggtacaggtcgccttcgctgatgaacctgacctgctgaaccccacctgctgtttcaagggggtagtgattcacgactcccttgcagtgacgtgccagagcgtccttcgtgttggcgtagccgagggctgtagccacgtccttgccgcagaacaggatctgcccgctagaggtgatggttcggattgtgccgaactcgtggttggtgaacacttgtagtccggtagccatgaccagctcctattctgagagccaagtagacaatcggcggcgcggggtgcgccaggctctcacctgtcaggcacggcagacaccgaaaccggacacggcttgaggaaggctctcgcccatacgcccccgagcaccgacaaatccggacgggtcagagggcacactggtgtgtgaacgtaccgataactccgtgccccgtgctcttgcttcggcgtcatcaaccaggtagccttgtagtcaacatgaccggttccgctgcccgcctcggtgggagtccagggccggtcttcgtttttcgtatcaaacaggggtgcgcgtggagcaggtgaagcagttcaagacctacggtgaacaggtcgaattgcttcgtcagcgtgggatgcgagtgaatgatccccagcatgctgagacgctgctggcgcgattgaactactaccgcttgtccggatactggtacccgatgcgccgtttctcccaaggcgacggcactgcccgagatgaattcgttgagggagcatcgtttgacctggtggtagccctctatgggtttgacgaacaattgcgccacagcgtgttcatcgagcttgatcgcgtggagttggctattcgaaccaagctcggtcacgaactgggtcgccttgacccgctgatctatttggatcccaagcgtttgagcgcccgggcacggcagcgaaacaaagacgggcgtagcgtgcacgaggtgtggctgagaaagtaccagtcggcattgaaagcgtcgaaggaggacttcgtcgcccaccacaaatccaaatatggcgggactctacccatctgggcggctgtcgaaatcatggattgggggatgctgtcgtacctgtacggcatgtcgcccaatatcgtgcgcaaacggattgccgagccctgcggcctaactggtcctcagcttgaatcatggctgaaatccttgaatattctacgtaattacgcagctcatcatgcaaggatgttcaaccgtgtttacgacatcaaaccgaaactgaacaatggcgtcaggctggctccggtagctgaaggaatgaatcgcgtgttcgggcagctctcccttatccaatacttgcaccgccaactggacttgtctccagccgaccggctaccgaagctgttccacacctacccgcacaatcccatcgtgccgttttctcgcacaggagcacctgacaactggcgcgagttgcctctctggtgcgtctaatccttgcggtagtagtcgcattcgtacccgtcggcgtcgagtggcagtcctgctgcccagtcgggtggggtcgtcatgagctggcaggcatcggcgatggtgaagccggagtcctcgggttcgtcgatgacgatttcgtcgtggacgtgcatgacaatcttgtgcccagcctgagcgacgagtgtcatggcgtggacgaggaggtcacgagcgactgcttggacgatgttctcgacgagtttcccgccgtaggtctccagccgcccccacttgcgtccggtcgtgacaccgctgtaggtgatggaggtgccgccccaccggttctcaccaagctggggcttcacgtaggccagccgcctaccagagggcagggtgatgaacaagatgccggactcggcagtgaagcgaaggttgcgcagccgaacagcctggcgggtggtgatggcgtcaagtgcggcctgctcgacatccgcccagagtcgcacgatgttggggttggctgcccgccaggcgtcgacgatgggtttgagttcgtgctcggccagccccatccgtagggcacccatcgccttgagcgctccgacggagccgttgtaaccgcaggccagcgtggcgatcttccccttctggcgcagctcagcgttgatgccgtgtttttcgacggggacgccgaacatgcgcgacgcggtctcgcagtagaggtctttgccgtcgcggaaggctgccagggtggatgtttctccggcgagccaggcgatgacgcgagcttcaatcgcggagtagtcggcgacgatgaatcggcatccggcgctggggatgaacgctgtccggatcaactggctgagcgtgtctggcacggagtcgtagagcagttcaagggcgtcgaggttgcgttgtcgggtgagggtgcgggcttggtcgaggtcgggcaggtagttacggggcaggttttggacttggacgaggcgtccggcgaatcggccggtgcgtcccgctccatagaactggataaggccgcgtgccctaccgtccgtgcctgtgacgttatgcatcgcctggtacttcttcaccgagcttttcgcgaggtcgccgcgcagctccaggacttctttgaccttgcccgtggcggactcgagggcggcttcgacatcagccttcgccaaggacgacatctcgcagccgtgggtggtgagccattccttcaactggatcggtgagttcgggttctccaacccggtcaactcccgcgcccgcgccaacgtggcggcacgatgctggtcgtccagggcgacggcagcgtctgcgagggtgtggtcgagcaggatgccggtgtcgttgatgcgttgatccagggcgtaggcgtcccactcggcttcgggaatcggaaacgatgagagccggtcgtggatcgcgagttcgacctcgacgtcgcgctggttgtagtcgatgaactgagcccagctggtcgggtcgctgctgggcaggttacgggtgccgccaccgttgagcacgctgggtgtggctggcgtgcagaattgcttgatcagccgcttacccgccgtatccttctgaacgtcaaggtcaagagccgcaccgaccgcatccaagctcatcggcagaccgagttaagccgaccacaccatcgtgcagcgccactggctcgggtcaagaaacccggccgccaacagctcggggtgatgacgctgcagccacgcggagagcgcgacccgctcgaaggcggcgttatgcgcccacttgaccacgcccgggtccaccaatgctgcgagcacctcgtcgggcagcccaccaccactggcgagatcgacgacttccaccgggccgccgtcgatcgagtagccgaagatgaggaggcggaagtcggggtgttcggcatacgggtagacgccggttttcgctaggggtgctgggctgaaggtttcaatatcgatagcgatctggcgcatcagggctcctggacagtcgggtaggcgaaggtgagggagccaaccggtgtttggtggctccctcactgctggggtgctacttcgggtcgaggttgtaggtggcgttcatcctgtcgagctcggccttctccttggcgatcagctcatcgatgcgctgacgttcgcggcgtttggcccgcttgtccttaatccagtagtagccccagaccatccagaacgggatcaggacgtagacccacacggcgagggtgatggcgttgaaacagtcactcatgattcagcctccttagttgaggaagtcgtcggccggcgcgccgaagtcggactcagcggagacgcggcctgcgccaaggggttcaccgtcgcggatcttctgaatgttgcccagcccgcacgccacacccttgttcccgttcgtgttgaacgcgtagaacgacagggagacgcgggcgtagcaacccgagtacacctcggaacggtcaaggatcggagagacgttctcgtccacaacctgcggcggagtgaggctgttggcgttgacgaagaagctgtttgcgtaggcttcgtcgtcacgctcggtatccccgtcacgcagcggcagcttcagagccgccttgttggagcgcttgcctccgaacttggccgtaccagcgtcgatcgccgcgtcgatggccttctcgatagctgtgatggtggtggtgtcggccttcgggatgatcagcgacacggagtacttgggcttgccgccctggatggagttcggctcccacacgtgagcgtaggagaggcggacttcgccggtgacgacgcgggtggggttgttggttgacaaggttgttacctgctttctgttttcgtgaattcggtttgtacgctgtggatttccagcgcgggtcgtttgtcggtgtcagacacgagcgtcggcttacccacgggcttgaccacgaggtcgccgagcacctcgttgaaggtcttcttgtccatgagccgttccatcgcagtgagcgtgatgagtctgcggtcgtagatgtcggcgtacccggcagcttcagccgcttcggcgacggcgttctcctccgtgtacttgcggacagaccgtccggcgacgagcttgaaaccatcccagtgcttgccctggttcaccgcctgcgagagcgcgtaggcctccacatccgcagcccacgttttgagctgtggaatccttgtcagcacgtccgcaatctcgctgccggacagctcggccggtggggcgaactcgtgctgggcgagcgcgaggttggcttcggcgcgtgctcggcacgtcggtgcgatgcggcagaactggcaccacgagccgggacagaactcgcccccgcccgccgcagccaactcggccttcggcttcacctcggtctcagcccatgcgaggaggtcggcgacgctggtttcccaagtgtcaacgttgccccgccggggctggtagatcgtcaccgcaacatcggtgatgtcatacaagtccccgaaagcgtggacggctccgagcgcgtacaacatgagctgcgggttgtgtgcggcctcgacgaggatgccctgcccgtacttgagatcgatgatctgcagcttgggttcggcgatgatcacgcagtcgccggtaccgaaaccgcccggcacgacgtgggagaagtcgaggcgctgctcgatcagcacctgcggatcaccacaggcctcccgtgccagtgagatgtgttcctggacgaaggcgacgtagtcgtcggtcaggtcctccatctcggtatcgatccagccggactcgggcttgaaagtcggcgcgtcgttcagggcacgccggagcttccactccgccagggcgtgtgcgacggtgccctgctcggccgccgccgacgtcgagtccggctcacgggattccagcaccgcgctgggtgggcagttcagccaccggtgcgcgcccgacgccgagagcagcgcatgctggtcaggcatcggacagctccttcgccttggccagcagccacccgtacttcgtcgggtcaaccgccgacagcttgtccgcgccggtggcgacgatcagctcacgcacctgctcggtcatgccttggctggagagcccggcgagcactccacgcacctgcgccagcgacaccggctccggctcaggtgccggttcgggtgcctgtcggtgggcggcctcgtactcagcggcggcctgctccaggtcgggttgtgcgagcccggcggcggcgatcggacgagcgccgggcatcccggcgtgatcctcgaacccctcccacgcggtctcctcaattgcggcggcgagcatggtgacacctgccgcgtcggccagcgccatcaggtcgtcgtcggtgtcggcgacacgcacctcgacggtggaggcttcggagccgggcaggagcacggccatgcggtgctggggtcggctggtgccgaagatcgcgcgcagcatccgcctgctggggcggatttcttttgcagcgagtgcggcagccgggctgggatgcttggcgatcttgatcttgagcttggtgggcatccgggtttccttccatgtgagtggtggtacgccccatcaccgggctggtgaagggagtgccttgcatctgtcaggcatgggacgcaccgaaaccggacggcctacgactcggtgagtgttttgcgcagttgggccagaccgcgcgagacggctttccgcaccgcatcggcactggtcggctggcctgcgccggtcttgtcggcggcgatctcggtgaaccggtcgccgtggagcacatgcagctcgatgtactcgcgctgcgtcgcagtcagcggactcagcagttcgaccaccgcgaggttggcctcgacctgctcggtgaagtccggatcgtccgaggcgaagtaatccgcgcccagcccgccacgctcgtcgtcatcaccgtggccgggttggtcgacggagatgtcggagcggcggcgattgtccagctcgcggtactcggcgtacacgtcgtcgaggtaggcgcgagcccacttcggacgcgaagccgggtcgcgcagctgggcacgcagttcttcgctgtcgggcaggtcagggacgggtaggtcgatggtgttgcccctgggggtcaggtacgggacagtgaattgtctgttgaatgccacgtgagggcttcccttcttgcgaagggagaccccgttgagggcaaccgacgagagaccgtggtgttgagcggaaacagtgacgggcaccaacccgacccgggggtgaacccgggtacaggtggtgcccgtcaagcgctcaacggaggtctcccgaatacggttgaaaaacgcatgcgggtgtaggaggaaggcggccggccggtgaccggtacggctttgaccgccacagcggttgggctgtcctgccggatgacgtctggccagcaggacagccgtgagggctacttgcccttacgcggcttggcctgagccagcgccgaggctgcgaccgacttcgtcttggccgaggtgcgaccgtcgcgcagcagtgcggacgccttcttggcgaccggtcgagacgtctgcttcgtgtttcgtgtatccatgtccctgttcacctcctgcctcagctcgctccgacacggttacgcgttcatgaagatgaacgcgacaagagtgaagcggccttgtaagatcgaaggaacacaggttcgctgttcgcccttgtggttctaggttccccgatgacggttttctgatcggctgggaagcgatgggcagcgatgggtcgcgatggagaggcggtgcggtggattacaagtcgagcttccacgccgtcttggcgacggtgcgcccgctgatgaaaggcacccgtaaccttggcgagttcaccgcaggtctcatcgacatgggactcgtgcctcgcggaaccgtctacggcgagaagaccgcgcttgagatgcgcaagtcggcgacgtggaaggggtacgccaacgggtctgaccagctgcctactgtgttagcgagcgagctggctgggcgatgggatcagtttcggttcgccagcaacgtctcccaggcatacgaggagtcggcactcaatgacctagccgaccggctccacgaccttgacgagtcgatcaacaagggcaatgtcaccgaaggtctaggccagctgttctacaaggtgttcaccgaagctgccggtgagaccgctgccgtaacggagcccttgactttggcagacaaggccgaccgatctggcatcccgtacattgacgagaagacgaatcgcctcaggcttggcgaccgctcggtcgcgttaccgccgaagcatcccacaccggacacagttcagcctgctgagctggggtatgtttcggcgctcctggccgcgcattgcgaagacaaagcccgtaccggcgttgaggtgcagctggacgacatcccgtcgcgtctggttcaacacttccaagaacagcgcaaagcgttctaccgtgccgaatgggtacgagaaacatcgtggaactgcatccacgatgggcggccattgtttgacgagttcttggaaacgatgcacgcgggagtctccgacaccaacttgcgtcagtaccccaacggactcgaacgcctcctcgcgacactggctcaagcagccgcagtccaactcgacggtgtccggctcgaccagatcattgacctgatcgacgtgtggagccggaaaggttcctgccacgaactcgtcgcccggaaccggctgggatgggtagattgatgcgcgccacgtccctagacacaagtttcgaagctgaactgcgcgggctcatcttgctgttcctgctcggagatgcagcggatgccgactacctgggtgccctagacaccatcaccgtcaacgcccacaccttcggggtcggggcagagaacctcaacggcacccaccgactggccagcggggaactccacacgcgcacagtcctgatgacccaagctctccagcatttggcgatccaaggattcgtgacactacagccagatcgttctccggcggccttcacgattaccgctgagggtgaatcagtcgtcaaccatttccgctcccgatacgccggtcagttgttcgacaccgcgttggagacgatcgagcgggttggcgacctgagcacgagcgagctggctcagatcatcaggtcagcgaccccggaaggagaaacgcgatgacaccaggcttctggatcagcagcatcaccgtggccgggcaccccactcggcgggactccagcgtcggtttcgaatctggactcaacgtcatctacggaccgtctaactccggcaagtcctgggtgcttcagtgcatcgactacgtgttcgggctgaaagccgacgagttcgtcctcgacgaaaactccggctacaccgaggtgcgtatgggggtgcgcaccgcgcagggctcactcacgttatcgcgccccatcggtgagggagccaataacatcgaggtctccagcacagacccacgaattgagtctggaacctacaaacgtcaatcgtctggccgttccccgctactcagctcggtgtggctcaaactcatcggctacgacgcccctgaaaacctgaaaatcatcaagaatcaaaaccttgaaacccaggcgttgacgtggcgcaccttctggcatgcgctgtacgcggatgaagaccggatcagcaccaagaaaccaatccttctccctcttcagaccaccgcacagcccgcgttcaaatgcgccctagcgtcactgatcaccggcaaggactatgccgcctacgctcgtgatgagtctgtcgaaacgaggaaattgcgtaacaacgcgatcatcgactacctcgagccgctacccaaacagcttgaagaacgaatcgagttgatcgacaaagcactcggtagcagcgacccagcagagatccagcagcgcatcgatgagctgatcgcagaactggaacgtgtccagcaacgcatcacacacgccaccgtgcaggggcaagacgtcatcgcacgcctccaacaggtgcgtgactcgctggcggaatcccgcagtctgcggaaccgatacgaggaacttgccgcctcctaccgtgcccgcatcgagcggttcgatttcgtcgaggaaggccacgccctcaccgcacacagggaaccggcaacaacctgccccgtatgcacgcaggcactaccaccggaagcgcgatccgcagttccagagcccgatctgcgtgaacgccacgacctagctgcccgactcaacgatcttcgtcaaacgatccatcagatggatcttgaacaggcaccactgcaagaacaagagcaggatctcgccgcagaagccgagcgcatcgcccggcgcatcagcggcgagttagagccgcaactgcaagccctctcgacttcgcttgccagccacaacgcgatcatcgccatgcaggcagaaagagaacagcacctcgaacgcaaacaagccatcgaagacgaacttgaagaacgcaagaatcgcacattccccaagggcaacttcaatccgctcgacgaatacccgaaaacgttctggccgcagatgggcaccaacctgctcgacatccttggagcctgcgcgttccccagactcaaagatgcccgattctcgcgtgaactgttcgatgctgtcatcaacggcaaaaccaaagcggaggaagggcagggctaccggtcgttcgtcaacaccgctgtcatgctcgccctccgggaatacctcgcctccgaggacgccacacacaaccccggcctgctcatcatcgacaccccactactggggctcgacgatccacagctcgaccccgagcttcaagaagcccgtgaaaccatccccgctgccctctacgactacctcgccctcgaacaagacggcggtcagatgatcatcgctgacaacaccaagttcatgcccgacatagaaccactaaaggaccgatgcaaactcatcgtattcacgaaacgcgaaggagaaggacgctacggcttcctgctcgatgcccaggacgaagacctgatcgatctggaggaaacagatgacaactaaccgcgccttcagctacaagcccctctggaaactcctcatcgaccgcgacatgaacaaaatccaacttcaagaacgtgcaggcatcagtccagccaccctgtccaaactcggacgcggcggcaacgtcaccaccgacgtccttgcccgcatctgcgaagcactcgactgtgacatcgccgacatctgcgaggtcgtccccaccgacctgaagggagagaccgactagatgaccgctcaacgcctgcagctcacctggtacaacaaggacaaggctctcatccccactgagaccggcaagtacggctacacgtgggttgacccctctgatccgcgctactgcgaaacccacaccctcgtgctggacgactatgtgcaaggcagccagacaccgaagtctgacgagttcgcctactccgagcgcgctgacctggagccccaggatgacaacctgctgatcttgggtgaatcgggcgatgtcctcgaagccctcacccgcgtgcccgagcttgccgagaagtacgtcggcaaggtgaaactgatctacatcgatccgccgtttaacaccgcgcagacattcgcttcgtacgaggacaacctagagcactccatctggctgaccatgatgcgcgaccgactgcaccacatgaagaagctgcttgccgacgacggctccatctgggttcaccttgactacgcggagaaccaccgtatgcgactgctgctggatgaggtcttcggttgctcaaacttcattgccgagttcgtgtggcagaaagcagactcgccgcgaggtgacgctcaacgtgtttcggtggatcaagatgtgatcctttgctatgccgcgagtggaagcacagtcatgaatcgtatggaaaggactgccgcagataacgcccgcttcagtaatcctgacggcgactctaaaggtgtttggttcagtgataaccgctccgcgcccacaaacgttatgtcttggcagcaccctagcacctttgcaattcagcacccaatcagtggcgagatgatctacccggccaagggtggatgctggcgttttggtagagaacgtctccttgagtcattgaacgagtacgcggagtatgcaagcggtgatgtagacattgcggctcgggttgcaaacacatcgcttcggtcagatcaggttcgttcagacattcctgacctggtattggtcgaccccgcttcagcggctcaatgtgctcgcacaagaattgatgatggaaattggccagaattcttcgtgactgcaaccagcttcggcagaaagtcctatcctcctaatgaaggtcagcctgcccgttcatggtggcctaatgatcaggtgggacacaatcgcgaagctaagtcagaaataaaggctctcttttccggtgcgacgcctttctctacccccaagcctgaacgtctcctcgaacgcatcattcatatcgggtcgaacccgggcgacattgtgctggatgtgttcgctgggtcggggacgacggcagccgtcgcgcagaagatggggcggcgttgggtgacgtgcgaattgctggagtcgacgttcacaacgtttacgcgtccccgtctggagaaggtgctcaacgatcaagacccgggcgggatcactcggactaagggcgaacgagtcgacgctacggaagacgggctgcctgatggtgtctcgccggaggacgccgcgaaattcacgagcgtgctcaacaagctgatcaaggacgacccggaattgaagaaaagcatcgaggtgaagacactgaaggctgcctcgaagaccagacgcacgaaggaagtagtgaactggcgtggtggcggcggcttccaggtcgcccatctgtcgcctgcgtgtttcgactacgcccctgaactggaccgggtgatgctaactgcggccgcgaccggacagactctgatcgagtcggtgactgccaacctcgggttcacactgttgcacccggatgatgactatatttttgatgcccgccgtggcaatgccttgttgaaggtggtggagggtgtggccacgaccgagatcgttgactggcttgcttcccaaatccagcccggcgagacaatcgtgctggccgccaccacggtgatggacggcgtgcgccagcatctgcgcaaactggtgaaggggtcgcgggtggtcgcattgcccgatgatgtgtttcggtacagcgaaggtggtgaccagtgatggcgaacaggctcaacatcagttttgactccgacatgctggagtcgatcagtgccgagttcgacctgcgtgctccgaacaaggaagcactgcgccagctggtcttcactctcgacggtgactatgacccgaccgtgatgcaggtgctcaacctcgctacgggcgtgggcaagacctacttgatggcggcgtttgtggagtatctgcgccgccaaggtgttggcaacgtggtgattgtgacgcctggtaagacggtgcaggccaagacggtgcagaacttcacgcctggttcgtcgcgctacattactggttcggcgcttccgccggaggtggtgactccgcaggattattcggcgtggatcgcgcgtcaaaacggcccggtgcaactcgcgttcgggcgagagactccgatgttggcattcattttcaatattcagcagttgattgcccctaagtctgatgagggtgacactttgggtggtacgcaggatgcgatgcggcgtaagcctcgccgtttcgatgagaacgccggggtgcttttcgattatttgaagggtcttgatgatctggtcgtgatcgctgacgagtcccacctgtacgggtcgagtgcggtggcgttcaatgcggctttaagagaactggatccggcggcggcgattgggcttactgcttcggtggataagaaaaccgatcacgtgatctatgagtatccgctgtatcgggcgatccaggacaaatacgtcaaagccccggtgttggctttccgtaagagtgggtatggcacggacgaggcctctgaggaacagcagttgcgggatgctttgcagctgcgggcgatcaaacaagcccactatgatgcttatgccgccagtgaaaaccgtgctcacgttaacgccgtggtgttcgtcgtgtgttcggatgtggaacacgctacccaagtagcggagcttttgcgtaccccggaatatctcgggcgtgacgaggcagtgttgcaggtggactccaaacatgaggacgagctgacgcagcgccgcttgaacgagctggacctgcccggctcgcccgtgttggcggtggtgagcgtgaacaagctcaaggaaggctgggatgtcaagaacatcgcggtcgtcgtgacgttgcgggcgatggcttctgaggtgctcactcagcagacgatggggcgcgggctgcggctgccgttcggccggtatacgggtgtgtggcagatcgaccagctcgacatcatcgcccaccaatccttcaccgagctgctcaacgccgagaacgtgctgcagcagttcggcctggacgaagccatcgccgagcccgacaaagccaaggtagaagaggcgatccgtaaagccgccgaagagtccggcacgggtacaggtacgcccacgaccggcggtgaccaaccaacgacgacaaccggttctgaaccgggcaccggtgtcagtggtgaggtcgccggtggtgtggctccgcagccgggcaccgttcccgtcggcggcagtgattccccgggtgcgggtttgcccggtatcggggttcgcaccatcaccgaacaggaggatcagcccacctgggagttggtttcgatcggacggaacccgagctttgctgacgtgtcctaccgattcccggtgacgacgatgactgtgcagcagccgcccattgacctgtcagaaatcagtgacgccgagattgagcaagcggcgcgtcgggtcacctctgctggggacgtgctgctgcgcaaagagatcatcgccgccctaggcaagaaactccgggcagaggatcgagaaagcgccgaagtcgactccgtccacgtcgacgacgccgacgccgaggaggcgctggtcaaactagtgatcaacatgtcgctggtgcccaaaaccgaacagaccgcccgctacgtcgccacgttcctggtgccgaagttcatgcgcaccgtgacgttcaccggctggaccgtcaaatccctcgactccgcccgcgccgaactcctagcgctgatcaagaactacacaaccgagacactgcgagccacccgcgaggtgccgaccatacaccccaagtcgatgccaggcaccggctacacgctcccgttgggtgagaaggtgcatgaccagatcgagagtcgtgaccagttcgtgcgaggccgggtctacggcggctggttcaagtcgctattcgccgaggagtccttcgactccttcaccggcgaataccagcttgctcgcctgctcaacacgtcgccggggatcgtgtggtggcatcgcctgcatccgcaagaccaggcattcgtgtactacaacgcgaaagaccgctacttccccgacttcgtagccttggacaccaacggggtgcattggatcatcgaaggcaaggacgagcgcggccgcgatgacgccagggtgcaggccaagcgtaaggctgccgaggcgttggtgcgccggttggtggctgaggatgcctacgccggtcagcactggggctatctgatcgcctacgagcaagacaccgcccgtgccgactcgtgggaagacctgaaagccttcgccagcccggtcagcaacgccctgtagctgcgagttcgcctgggcgcatcacggggctccagcgttgcgggaggtcgagggtgacggcctcgccggtgatgaacacgaatccgagcctgccatcggtgagcatgcagccgccctccagcatggcaaggaagtccgggatgtggagcgcaagctgggtcggcgattcggtcaggagcttgtcgatcgccgtgtggagcgtcgatgggcgtcgccgcgcacccgttgactgcaggctgtccacggcctggtcaaccgccgtgctgttgcgcccagcgagcacctgcaacgcctcggccatcttcaccagcagcacctcctggtagaggtggctggtggtgcaggtgccgcgcttgacgtagttcgtggggcactcccacacgtcgacccggttcggggtaccggagtgccaggtcttgtggccgaacggccgtccgcagtcgccgcagacgatcttgcgggacaggcgcttgccgaaggacttgtagccgcgtgggtcgacgcgggtgcccagccacggcaactcgcggtctgcaatgccgagagcctcggcggcgtggcgttgggcgtggaatgcgtccatccactcgacggtgtacccggcggcgagattttcgaggaggaagctggtcagccggtaggtcagtcgggcttgtactgttgcgagttcggggtattgcatggtgggggctcctgtctttgcgtcacgtacatacacgctctgatcagggctaatagcaagtcgtaaacggcgataccttttagcgcttgccgaactatttggcgctccgttgtcagcctcgacgcacgtggttcacgccgccccacagcgcctctcggacaagccagccaccggagccgatccgtccgaatatgcggctcgacggtcaacactaaggcgcgttttacctagtggggagcgggtttcgccccatctgcgtcatccgcgcaccacaaacccctgtatccacttcgatacagtctgc

SEQ ID NO: 68 - DNA, 32951 bp, Propionibacterium acnes
ggtggtgccgaagaagaaggaatggccccaccaatctgctggtcggtagaagtacggggtttgagccagtcgagtagtttcataatctgctccttgcaaggtattgtgaaggatatgaaatctcttacccctcatttgcttctctgctcttttttcacaagcattgctcctgccttaggagaaggatttcgcaacaaacgtgtggctttcattccgacagcagcagcccacgaggagtacacagcctacgtggattcagcacgctcatcatggaaagaacttggcagcaatatcaccgatgtggatattgccagaatgcctctaagaacagcgaccgaggcgcttgagcaagccgagataatctatctttcaggagggaactccttctacctcctcgattgcctacgctcaacagaaatcgaccagattattcgagggcgtctggccgaaggggcgattctagttggtgaatcagctggagctatagtttgtagcccaaatatcgcctacattcagccaatggatcgtgtccctgacaactacagccaggctgactacaccggactgaacttagtggacttcttcccggtacctcactacctcgcccctccatttgtgaagagttccaaggaagtagtcgcccagcacgctagcctcccactcgagctcatgaacaacgcagaagcggtaatagtagagggtccccaaaggacaaagatctcatcagagcaccagtagtcctcgtgagtcgtacaccgacgtgcccgtgtggctgccaccgcctcggatagcgcggtcgagggccatgatggtggcgaccacctcgtcgatcttctcggtggacttttgcttgtcgggtttgatgtttcctgccgggtcggtgcggacgtgaatgttgtcgaccatccaggacagcactgggtgcctgccgtgagcgagcctaccttctagtgcgagtctcatgagctccttggacggtgggctcatgtctttgaagccttgcccgaagggcacgacggtgaacccggcatcgtcaaggttttggctcatctggactgcgccccacctgtcgaaggcgatctcgcggatatcgaagcgtgtcccgagttgctcgatgtggcgttcgacgtgggcgtattggacgacgttgccctccgtggtctctaataagccctgttggtgccacaggtcgtagggcacatgataacgcgccacccgcaacgccaggttgtcctccggtatccagaaccacggggcgatccggtacttcttcgtccccgtagggtgggaagatgaggacgaaggcggtaatatccgtcgtagaggcaagatccagcccgccgtagcagcgtcttccttccagctcgtccaggtttaccgggtcggctcccgcgtcccagatgtgcatgggcatccaccgcaccgactgcttgacccactggttcaacctgagctgccggaacgtgttctcctcggcagggttctgccgggccgagttgcacgccgcgcgcaccttgtcgatcggcaccgtcacgcccagtgaggggttggctttgcgccacacggcctcatcggtccaatcatcatccgcgtcggccccgtagatcaccgcatagaacgtcggatcatacttcttgcccgcgaggatgtcctggactttctggtgctgctcatagcaaatcgaatgcgtatcagttccggcggtggtgatcaggaaatacagcggctaggtgcgtgcgtcgcccgaacccttggtcatgacgtcgaacagggctcggttgggttgggtgtgaagctcgtcgaagaccacgccggagatgtcgaacccgtgcttgaagtaggcctctgcggagaggacttggtagaaggagttggtgggcttgtagatgattcgcttctgcgaagagaggatcttcacccgcttcgacagggctggtgattggcgcaccatatcggcggcgacttcgaacacgatcgaggcctgccgccggtcggccgcacacccgtagacttcggcacgctcctcaccatccccacacgtcagcagcagggcgacggcggcggcaagctctgatttgccctgcttcttggggatctcgacataggcggtagtgaactggcggtagccgtcggctttgacggtgccgaacaggtcacggatgatttgttcctgccagtcgatgagctggaagggctgtcctgaccagcggcccttggtgtgtttcaaggcttggatgaacgcgaccgcgaagtcggctttccgcttgtcataggtggagcctgcggccatgaaccgggtcggcgtgtaggtgtcgagagtgcgcatcacgcccgtcaggctccttcctgtgctggttagttggtgtgggcgaaggcccaggcgatggcgtggccggcgtcagcgaacagttcgtcagcctcggcgaccaggtcgagttcgcattcactgaagcctcgggcgtcctgtccccagccggagatcggctgctcggcgaacttgtagacgcgggcgtcgtttccgatccggcctttgcccaagtgccggtaggccgaggcgaggacgaagtccccgtaggcgatcaccgtgccgtagctgtcggtcgccatctgcagctgctccatcgtggtcttttcgttgttcatgaccttctccttcttgccttgttcggtcatgtacatacagccataggtgcgcgctcttatccagtcgtaaaagccctagtcagcccactatttttgaggaatctttgaggggcgacgggcacggaaacggcccctgattgggtgggtacccacggtggcttggggtcagtcgatggccaggtgccaggcggggatcatgcggcgttccccggtgatcgggtctgggtagcggtcgttgacttgggtcatgcctcgcagggttgcccctgcctgggtgaggttccagatgatcgtggtcaggccggtctggttcgcgctgatcgtgaactcgccgatgctgtgctccttgagttcgtcgaggatgctgggcacgtctgagtcgtagagaccttcggcgaagtcgagcagctcgttgcccgcccgctggctgttcatgtagacggtgagcaggctcgtggacgaggtttgggtgcgggtcgcgatcttgctggtcgaggtcgtcaattgtgttcatcgcgggtgtccttgtgggtgggtggggtgcgccaggcggcgttgccgtccaagtgtttgagcaaggtgcggcggacgggtttggtgtcgtcgccgatcagaccgaggcgcagcagccagcagcgcatcgcatatttgtcgttcccgcccgtttcggcaggtttggctgaggctcttgtggcggttttggcgtggtcgatgatccgggcgatcagcaccgtggtggcctccactacctgcgggtcgggcgctacgtcgaaccaggggaactcgaccgtcccggcctcggcgtcgatgctcatcggggttgcggggatctggagtgctttggcgatgagctctcctttcgctgctagcgtcgcctccaccttccctttcgtggtgtcctcccaaccggtggtggggaacgccaacgtcaaccccaactcgcctggctcgtcggtggtgtccgtcgggaatccggcctgcgcggccgcctcgaccagcccggccacgtcggtgtcctcgggcagatgcagcagccagtcacgatccaacatggcctcgccaatctggtaggcaaacgttggggttcccagatactcgacggtcgctcgcagctgggtggcgagaaaagcggcgagttgcttgcggcctttgcgctgcttggtgaacttgagtgtcgtcatgaccggcctcctttgcgtgttcccctggtcggagtggttttcggtcatgtacatacacgctctatcccgaccagatagcaagtccggacggccacctatttcttgcctcgatccacggccttcaccacatccaggtaggccaactgttggccgtcgcgcaggcaggtgatacctgcggcgtccccggtggcgtcggcgtagcggcgcagaatgactgaggcgtatttctcgtcgagctccatgcagtaagcgatccggttggtggcctcacacgccatgagcgtggagccagagccggcgaacgtgtcgagcacgatcgcattcgcctgggtggagtttccaatcggatacgccaacagatccagcggcttcgaggtcggatgatcagcattcctgcgaggcttatcaaaccgccagacggtggtttgtttccgatccgcgtaccacgtgtgcttgcccgtcttcacccagccgtagagaacgggctcgtgttgccactgatacggggaacgacccagcaccagggagtccttgacccagatgcaacaccccgacagcttgaagcccgcgtcttgaaaggcgcgccggaagttcagaccttcggtatcggcgtggaacacgtacgcggacgcgcccttctcacacacgcccgccatctgagtgaacgctgcgagcaggaactcgtagaacgcgtccgcgctcatcttgtcgttcttgatcgacaagccgtcagacgattcgaaggcgacgttgtatggcgggtccgtgagcaccaagttggccttcttgccatccatcaacagctcgatgtcgcccgcgttggtggcgtcgccgcacaccagccgatgcctacccaccgtccagatatcaccccgctcgacgaacgcggcagcctccagggcggcggtcagatcgaagtcgtcatcctccacctcgtcctcatccaaggagccgatgagctgggcaatctcatcgtcgtcgaacccagtcagctcagcgtcgaaatcactcgcgtccaggtcggcgatgagcagggcgagcttgtcctggtcccagtcgccactgatcttgttgagcgcgacgttcaaggctttttcgcgggtctcgtccaactcgacgaccacgcagtcgacagtggtttcaccgaggtcttcgaggactttgaggcgctggtggccgccgacgacatggccggtggtcttgttccagatgacaggttcgacgtatccgaactccgtcagcgaccgcttgagcttttcgtagtcggggtcgccgggccggaggtctttgcgcgggttgtagtcggctggcgtgaggtcagcgatgggtagctgctcgatgcgcacggggctccaccgccttccgcaggtcgcgctcaaaacgccaggtttgttcccagcgcggccaatcccggcccatgtgcccgtagaccgcgagatcccggtaacggggtgtgcgcaggttgaggacgtcgatgatccccgccggccgcagcacgaacacgtcacgtgcggcggcggtcaagatgtggtcggcgtactcgccggtgccgagcgtgtccacctcgaacgcgaccggatcagccttcccaatcgcatacgagatgcccacctcgcactcagcggccagcccggcgtcaacgatcgtacgagcgatcaggcgagccatgtaggccgctgaccggtcgaccttggatgggtccttgccggagaacgcgcccccaccatgagacccgagcccgccgtaggtgccgaccatgagcttccggcccgtcagcccggtatcggctcgcggcccgccctcaacgaaccgacccgacggattcacaagaatttcggtgtgctcgtctatgggtaggtaggtctggcaggccggggccacaatcagcgagcgcacctcacgctccaacacggccagatccttgcccgcctcatgctgcaccgagaccacgacggtctcgacggcggcgggggcaccggtgtcgtcataacgcacactcacctgggccttgccgtccgacttgatcccgcagatcgtcccctcgacctgggcagtatcgagacgctcgcagatgcgatgtgccaggacgagcgggagcgggaggcgttcaggggtctcggcggtggcgtaaccgtagaccgtgccctgatcgccagccccctgcaacgcgaacgccgaactatcaccaccgcgtgcctccagcgaggtggtgaccccggcgttgatgtcgctcgattggcggcgcgtccacacgtagatcaggatcccgagcggactgtatccggcacgcgcgagggcggtgcgcacagactcccggatacgcgggcggtggttggtggtgatttcgccggtgacgatgatccgccgaccggctgccatcacctccaccgccacccgtgcggccttgtcgtcgtagaggatgtcgtcgaggatctggtcggcgatctgatcggccaacttgtccggatgaccagcacacacagactcggcagtacgaatcgaacacataagcacactcgcttccacgaatcggaggggaacaagaaagcgtccaccccactagagggtggacgcgaagatcatgaggggcggttaggagcgggcgttgagcagctgctccatcacctcgtcgccgggcgtggtgcccgcgtagtcggtggtgcaggtggcgcgcacgatctcgtaaatctcgtaccaatacacattcgcctgcttcccgaaactctgggacatggcgacaaacgggctggcgatggcggcaccggtggtggggtgcttgccgagcaggccgaacttggagatcgcctgctcgcactgcacataccgggcaaacgcctgcgcatacgcctcaatcaggcgaggcgccacgaattgggaaccgccacgttgatcgagccactgccacgtctcccgatagacgaggtcagcgccaagcggtttgccgtcacgctgaatctccgacagatagtccgatggttcgggcatcgtctccccggcaagcaccgcaccgtcgccaatgtcattacctgcgaagtcgaagggttcgttgagcgggtcttccaggcgggtggcggggcgtccggcggcgagtttctcgcccagcgggccgggcttcgcgcctgcacgcacgcggcgtccgcccctgttggtgccgtctttggccatgggtcgcctccccgccgtagaatcgtcatggtttcggtgctgaagtccacgggaggtgtgagtggttgagtctttaaaactattcgttcggacctacgtgtattgggtagggctcatccttggcttcgcgatagtgcccggttctctgctcttcactgctgaagtcgccccggtgaacactccattgtggcttgcacctttcgccgggctgctgctttttgtcattgatcggccatcaacatgggagccgccgctctggcgagcattactgatccgagtattgggtgcaggatttgcagccaccatgctcatcgcgtttgatgcagttgcttccacccactatggatctcaacactggagtgagacgctcctatctttcggtctcggttggattgtcttcacggtagtggcaggacacatgctcatgagcagctccgcccgatttggcacacctgctcacacgatcagggacgcgatccgtacctacacgacatggataggaatctgcttcgggattttctatatccccgccgcgggactctccgcagctggcactcttttgatggttcttccgctttatggaacgttcctcgccggcctggttcttttgatagttgacccgccacgacgatggccgcaaccgcgagtgaaggcactgtggatacgactcttgtcaagcgtggcagcagcattactacttgttgtcacgaactcgttctatcgcagtactcgcacacacgagattttcgtcggggactggcaggaaaacctggtcttcttcgtgggtgcttgggcactttatgccgcagtggctggggccaggtatcttacgcctggccccagccacgaagcagatgacaaactcagtagatgaattcagctagagcttgacatgctgccctcttggtttcttcgctaggctcaacgcccgagtagccgtatgccccattggaaccgtctgtgagaaggccaacgtatctgtcatccaatgggccatcaatttctgcaaagaacttgtcctttgcggttcctccgtcgcttgcaccaacactctcagagatcgccttgaatcgctgcaatagcgaaactggattgttgtagtagctcctcagcgttcgggacagaaggttggggtcgtcggctcccgagcctttcagcatcgcagccagtttgatcgcatccccgtcgctacacaggtcggagtagttgcagttgttcggcagatcattggggatggtcaaaccttgaagtccgctgtgattcttatagttatccccttggccaacaagagcccttgctattgcaataatgtttgagccgggattcaggtcaacaaccttttgaatcggaccgagcgctgaagctaagtcacccgcccatcccgtccacttatcaggaacgagcgggttcaggttgatgtagcccagggtggtcacgctcatatgcgggatatctactgcaccacctgcggggtccgtccattcttgtcgatcggagcgaatccacttattcaaggcagagattatctgagacgcttgagtgtcatcttccagccttttcgcgtccgcctcccgatatgcttcagctgccgcggaccactttgcgcttcccttgaggtagaccgttgataggtagttgaggacacatcgccaagtcggaactttgacccaagtaacgtagctgccggatgtgatcggatcctctccgaaagcgtagtccttatagaccacgcgcaattcctcgaaccggctctcaagcgcttcgatcagatcgagaaaatctagagcgtcgtaattcactggctgcgcgtggcgcaccgacgaatcggctgacatgcgacccgaatatgccacgcggtcaagatcccatttcccccgatatccactgatttcgtggaactgatcaaatacccagttgtcggggatggggaaaccgagattacctgagaatccggtagacatgtcagaaacgaatgatgctaccgcgtatccagcctgagctatccgggtgcagatgtttcgcgaggcgtagatacccactcggtagccgccgccgaggctttgcgttactgccttgaagtagggcaggatgtggctggtcacctgaggatccgtggcatcgtagtcaacggcgaagtagatcactgtaggtggaacaccaagtcgttgggcagcggtttgggcctctttcgcatgacggtgcccattttcgacactaaagtacttaagttcagttgagtactcttgaaaaattgggaaatacttcagcccatgaccaacgattcgctctagctcgcctgtgcggagcgccttgaaatagtctgcctcagacttactgctttggttgggttcactgagatagcggcctacgatctgataaccatcagccttaagatgtccagcaagctcgtcagtgatctcaaagcgcgtatcgcaagccacacatggccgattggggtcgcctttagaagtgagcaggctcatccatgtggttgggtcgaccaccccggtcactggcaaggcgtgtgcttgctggaactgccacagcgtgttgctgatttcgctgttccacgtgctggtcggcaaaatggagtagccgttgcagaccagactcacagtggctagccatacccactggttagtgccgctactaattgtccgtagtttggagcgagtgcctgcaccaaaattcccggtggcttcggcaggtgtgtatccttcgattgcttggaggacctggattaaagccgtgttcatttcacgcccgtacaagccatcagtgggaatgatccctgtgtagttcttgtacccacggttaatcgcttgctgtgcctgacgaatagctgtcttgccgccgtaggcagagagtaaccggaactgtttcattgacagaagcgccatcattagttcaacatcgaccgttgcgctcgtatcgccaaggccaatatcgactttcatctggcgaatagagtcggccaagtggtcggtaaactcaagagtgatgccaccgtattcggctcgatatcccttgcaccacaaggctccttgaataatcccatgaacattgtcgtagccagaagtttgagtaatgccgtttggccaacgagacttgaatcgagactgtgttccagaaccgaaattgtttgccgtcgctgtaatacccagttcgatttgcagagcgcggatgagtgcgttgattgtatcccagccagtgttaccggtttcttggactgagccgaacccagttttattgccgtaagtcgaattcagccactgctgagttttcagcaccatttgatctgccatgattcctccttcagaaatcagttgttaactcgaggcaggcgaacacctgccacggaggggtccagaacaccggatgagaagctccgagttttttgccctcgcctgtacgtcaccgggaaacccgaatccggacggcaagagcgaaacttcgcgagtttcatccctcactggtactgccgacgaagcccgaagtgttaataccctgtttgattctgggactttgcgcgcagttggccccgcccgctgacctgtccgagcgtcgtagagatcgagaggccccaaccccctcgccagcgccgccaggttcccccgtgtctgccgatcagcaccgaggtgggcatctttgaggtttcgcaacctcggcgcgacgtggcgcgacgtggcgcagatttcagtaggtgtagatcctcggggtctgcctccaccggtcgccgtcgagcgccgactggcgggagtggcacggcttacacaaactgcggaggttggcctggtcatgggtgccgccgtgctccaacgggatgacgtggtggacttcctgcgccggggtgtaccggccagccgcgaggcagtcctcgcacaaggggtgggcggtgatgtaggcggtacgaatcttgcgccagcgggccccataacgtcggttgatcttcgggtcacgctgccacttgcggtagcgctcgtcctccgccttggcgtgggcttcgcagaagcgggcgtgggtgaggttcgggcagccgggctgggaacacggacgggcaggcttgaccggcatcacgcacccctttcccggacacggcaaagccccaaggcacccagccgatgaccgggcttgccctggggcttttcctacttttcaaccacctacatcattgcaggcccgaaaccctaaatgcatccgcagttcttgacaccttttggcggctaggttcacgcggcctgcccatacagcgccgacgccagccgggcgagcgcccgagacttcttctggtaggcgctggtgcgctccacgtagaagtggtcacacaccgtttgcaccgcctcatcctgggtaccgtcgccgaggaagaatgcttcgagcacgaacctgtcgtcgtcggtgagcagctgccaggcgggcaggaaccacgccatgtactcacgcgcctgggcgtaacgggcacggtagatgtcgatccgatccaacgtggccgccacccgcatctccccagcatgcagatccgtgtggcggggcatcccgtcgagtttcgatgaggctggggtggtgacgtcgtcgtaggcggtcttgatctgctcgtcggtggtgtcgatgatctgctccatcacggcgaagtcctgcaatgcgctgatggctgctttgcgggtgtcgaggtatttggtcatcacatgcatgacgactccttcctgcttatggttgtgagttcggtggcgaccgcgtcgatcaatgcggcctgggtcatgtccttcgcctccagcgccttgaggacggcttggtcgagggtgccggtggcggtgaggtgggtgatggtgacaggctcggcctgtccttgtcgatacagccgggcgttggtctgctgatacagctccaagctccaggtcagcgagaaccacacgagcaggtggccaccggactgcagattcagtccgtgcccagcggaagcggggtggatcaggccaagcgggatgtcgccccggttccacgcctcgatgtccgccgacgtcttcagttcgcgggcttgtgggaagcgacgctggatgcgttcgcggtcgtgtcggtaccagtaggcgacgaggacggtttggccgttggcggcctcgatgatgtcttcgagggcatcgagtttcgccccatgcacctcgaccgtatcgccgtgctcgtcgtagatcgcacccgaggcgagctgcagcagcttgcccgacagcgcggctgcgttcgccgcatccaccacctgcccatccagatcaaccaccaggtcggccttgagctgctcatacacagctcgttctccggctccgagcaccacgggcgtggtcgtcaccgtcagatcaggcagcgtgaggtggtcggtggtgcgcattgacaacgtcatgtcggcgatagcgtcgtagatttcctcctcagcgcctgccctcggcttgtacgtgaacacctgcatcccgttgcgcttatccggcaggaaccacttgtcgcggtagcgggtgatgaatctgccgaggcgttggccgccgtcgaggagccggaattgcgcccagatgtccatgagcccgttggaggcgggggtgccggtcaggccgacccagcgcttcacgtgtgggcgcattttcaccaacgccgtgaaccgcttcgcacggtggttcttgaagctggagagttcgtcgatgacgaccatgtcgaacggccagctatcgccgtactgtctgacgagccaggggatgttttcccggttgatgacggtcaccatcgccgacttggccagcgcgtcgagccggtcagctttggtgccgaccgcgaccgccaccgatagaccttggaggtggtcccacttggctacttctgctggccaggtgtcgcgggcgacccggagtggcgcgacgacgagcacccggctgacggtgaagtagtcgagcagcagctgccagattgccgtcagggtgatgacactcttgccgagtcccatgcccaggaggatcgccgcttcgtggtggtcgaggatgaaccgcgtggcggtctgctggtagttatgcggccggtagcgcatcaagcacctccttgatgccgtccaccgagtcaacgaccagcgcggtgaagccgtgggcggccagttggctcatccggcggcgttggatcggccgaggcttcttgccgggggctttcacttcgacgaagacgacctggcctcccatcaggcatagccggtcaggtacgcccgtggttccagggcagacaagcttccagcacaagccgccggatgcctcaacggccttcttgagctgggcttcaatgtggtgttcgttcatggtcactccttgagtggtttcccacgggggtgacgactggtgacgggtggatctggacttttctaaaggagatatttttgtggccttagtaatagttcaatactgatcgtcaccggtcgtcaccctcatcgggtttagctgttgaattcgctggtcagagccagtccgtagacgtacatgccatgcttggacttgcgtcgttcaaacccggattgttcgagagtggcgttgaagtcggccatcggccgagcccacccgctggtggattgcgcccacgctcggtactcctggtacaggtcaccggcgcgttcggatagggacgggtccacctcgcagcgggcgtcgaggaattgggcgaaccagttgttctcttcccgatatgcgcttgaggcagcgaccacttgggcgggtggggtgagctggtagtcctcggcgtggatgagccgcgagccttccatgatccatgcaagtaccgctccgccggcggtctcgtagaggtggtcggcgtagttcttcacatcggagctactctcgatgaccgcgttgaacgggatcacgatgagcctgcgccagatgcccgcatccatcgcgcccaccctgggcaggtgattcgtgtagaggatgagcgtgtgggatggggtgaacgcgaacggtgccttgtatttcttctccgcgtagatctggtcggtggaggcgagttgcttgaccgtggaggtggataggcgcacgccttcctcggactctgcggcgatgatgagccgtttgcctttcgcttcggcaagctcaggtttgacgttccggttcccgccaatggtgagcacgtcggcggacatgttgcccgcatacgtgccaagcactctcgcgatagtgttccagaacgtggacttgccgttgcggccgtccccgtaggcgatcacgagggcttcgaccatgaccgtcccgatcgctgccagcccgacgatccgctgcacatacccgatcagctcccggtcggattggaagaacacgttgagcgcccggttccagatttctgcgcccgtgtcggtggggtcgagcgcggtttgtttcgtgatcagatccagcgggttatggtcacgtcgggtgccgtcacgcacatcccacgtgccgccaggcgtgttgaggagatacgggtcagcgtccagccgggctggggtggtcagcaacatcgggtgtgcttccctcaggcaggaggtgatcgcccgggactcgcggcgtttcaacacgaacgcctcgtatgccttcgcgtcctcaaatgcccggtaggcggcccgctgcggtgaggtgaaaccgccgagtgctttcgctttcgacgatgcggctgcgagcaccgcgttcgcgcccgtcaccatgagctcgtcgcgggctttctccagcagatgcccggcctcggctagttgccggtcggtcagttcctgggcgatgccttgcgcagcaggcgcagactcagaccacacaccgccttcgtagacgagccagtccgtggcctccgtaaacgccagacgcgacgagtattctgcggtgagcatggatgcctgcccgacatcggtgaagtcctccggccgcaggctcgtcagctccgcgtaggcttccggcgacagataacccggctgcgcctcgactttggcggcgaaccggcaggcgctttgccagatcgactccaactcgtgatccgacaggggcggttcacacagggacgctttccggtcgaacaggtcacgagcttgggcggtctgcccgtaacggatcaggacgcgtccggcgaagcgggagagggtggcgttgcgggagccttccccgatcacctgcgtggaagcgtcgaacgcggcgaacacgtcgatctcgtcggcctcatccagccaggcgtcgagcagctttgtgccgttgtggatggtggtttcggggttggtggtgccgtagatgaaccgtccggcatccaacgcctgcgggtcgaagaacccgaaccgtccagcgaggcggcgcttcaaccccgcataggtgtcggcgtcggtgaccgggctgattgggaagtagacgtggaagcgaggcctggccgacagcgtccttttcggcttctggtggttacggctggtggcggtcatgaactcaacccccgccatcagctcggccaggtcatctggggtgatccactcgtcggggttgtcggtgtggtcgttgtcgatatccatcacgacacagtccgaggagatgaagctcgccgaggagcgccggtcgccggtgtaggtggcggcgacgtgatccaaccacgccacctgctccagcgaggtttggtcggtgatgtggtggtggttcgggtaatggttattgtgcgggttgccgctactcgtggcggcgcacaaggtgaacggagtcatgcgggatgcacctcctggaagtcggcgtcgaagaagcggatcgggatatccatctgatgggcccagtcgatctccgcccgcatccccgggctgaccctgccgatataggcccacagctgctcgcatttcgacagcaggatgcggttgaaaaacatcgccagctcccgggcatccgggtcggtgtcatccatgaactgcggataatgcaaatgcggagccaacgggatctgacgagcctttaccgcaaacgcacaaaaccggcgggcaagctccacgttggctgctatgtcacccgagtacggggagcagatgtagaccaatgggcggtagccgtattcggcgagctggatttctttcagcgcctggtagcaggtcgggtcggggtatccgtcggcgttgcgcagcggaatacccacatcgatggtggcggtcatcaggcgccctgaccttcacgttcgatcaccggcagcaggccacgggtgttcttcaacaggtcgtagatgaacaggcgacccttctgcgtccagtacatgtgggtgcgggtcttgccctcgtcgtactcgtgcgtcttggactgcgtgtagccctgctcggcaaatttcgcgtagaggaaccagcgtccggactggtggaactgcacctgctcctcgcgcagaatctggttaagcttcttcgccgacagcccgtagtccttggcgatctctgtggcggtgatcagtgagggcgatgccagcacgatgtcgtagtacgacaccttcggtgccgcctccaacaaagcttgctcggcggcgagccgcttggcacgttcagcccggagcgtggtgatcgcccgctccagaaactcgtcgtcagcgagcagttcgtcgatggcgtagataccatgtcggcggatcgtcggcagaacctcgtcgaacacccacgtctcgaacttctgggcggcaggaagtttggaagtgacgatcagccggtacaggtcgccttcgctgatgaacctgacctgctgaaccccacctgctgtttcaagggggtagtgattcacgactcccttgcagtgacgtgccagagcgtccttcgtgttggcgtagccgagggctgtagccacgtccttgccgcagaacaggatctgcccgctagaggtgatggttcggattgtgccgaactcgtggttggtgaacacttgtagtccggtagccatgaccagctcctattctgagagccaagtagacaatcggcggcgcggggtgcgccaggctctcacctgtcaggcacggcagacaccgaaaccggacacggcttgaggaaggctctcgcccatacgcccccgagcaccgacaaatccggacgggtcagagggcacactggtgtgtgaacgtaccgataactccgtgccccgtgctcttgcttcggcgtcatcaaccaggtagccttgtagtcaacatgaccggttccgctgcccgcctcggtgggagtccagggccggtcttcgtttttcgtatcaaacaggggtgcgcgtggagcaggtgaagcagttcaagacctacggtgaacaggtcgaattgcttcgtcagcgtgggatgcgagtgaatgatccccagcatgctgagacgctgctggcgcgattgaactactaccgcttgtccggatactggtacccgatgcgccgtttctcccaaggcgacggcactgcccgagatgaattcgttgagggagcatcgtttgacctggtggtagccctctatgggtttgacgaacaattgcgccacagcgtgttcatcgagcttgatcgcgtggagttggctattcgaaccaagctcggtcacgaactgggtcgccttgacccgctgatctatttggatcccaagcgtttgagcgcccgggcacggcagcgaaacaaagacgggcgtagcgtgcacgaggtgtggctgagaaagtaccagtcggcattgaaagcgtcgaaggaggacttcgtcgcccaccacaaatccaaatatggcgggactctacccatctgggcggctgtcgaaatcatggattgggggatgctgtcgtacctgtacggcatgtcgcccaatatcgtgcgcaaacggattgccgagccctgcggcctaactggtcctcagcttgaatcatggctgaaatccttgaatattctacgtaattacgcagctcatcatgcaaggatgttcaaccgtgtttacgacatcaaaccgaaactgaacaatggcgtcaggctggctccggtagctgaaggaatgaatcgcgtgttcgggcagctctcccttatccaatacttgcaccgccaactggacttgtctccagccgaccggctaccgaagctgttccacacctacccgcacaatcccatcgtgccgttttctcgcacaggagcacctgacaactggcgcgagttgcctctctggtgcgtctaatccttgcggtagtagtcgcattcgtacccgtcggcgtcgagtggcagtcctgctgcccagtcgggtggggtcgtcatgagctggcaggcatcggcgatggtgaagccggagtcctcgggttcgtcgatgacgatttcgtcgtggacgtgcatgacaatcttgtgcccagcctgagcgacgagtgtcatggcgtggacgaggaggtcacgagcgactgcttggacgatgttctcgacgagtttcccgccgtaggtctccagccgcccccacttgcgtccggtcgtgacaccgctgtaggtgatggaggtgccgccccaccggttctcaccaagctggggcttcacgtaggccagccgcctaccagagggcagggtgatgaacaagatgccggactcggcagtgaagcgaaggttgcgcagccgaacagcctggcgggtggtgatggcgtcaagtgcggcctgctcgacatccgcccagagtcgcacgatgttggggttggctgcccgccaggcgtcgacgatgggtttgagttcgtgctcggccagccccatccgtagggcacccatcgccttgagcgctccgacggagccgttgtaaccgcaggccagcgtggcgatcttccccttctggcgcagctcagcgttgatgccgtgtttttcgacggggacgccgaacatgcgcgacgcggtctcgcagtagaggtctttgccgtcgcggaaggctgccagggtggatgtttctccggcgagccaggcgatgacgcgagcttcaatcgcggagtagtcggcgacgatgaatcggcatccggcgctggggatgaacgctgtccggatcaactggctgagcgtgtctggcacggagtcgtagagcagttcaagggcgtcgaggttgcgttgtcgggtgagggtgcgggcttggtcgaggtcgggcaggtagttacggggcaggttttggacttggacgaggcgtccggcgaatcggccggtgcgtcccgctccatagaactggataaggccgcgtgccctaccgtccgtgcctgtgacgttatgcatcgcctggtacttcttcaccgagcttttcgcgaggtcgccgcgcagctccaggacttctttgaccttgcccgtggcggactcgagggcggcttcgacatcagccttcgccaaggacgacatctcgcagccgtgggtggtgagccattccttcaactggatcggtgagttcgggttctccaacccggtcaactcccgcgcccgcgccaacgtggcggcacgatgctggtcgtccagggcgacggcagcgtctgcgagggtgtggtcgagcaggatgccggtgtcgttgatgcgttgatccagggcgtaggcgtcccactcggcttcgggaatcggaaacgatgagagccggtcgtggatcgcgagttcgacctcgacgtcgcgctggttgtagtcgatgaactgagcccagctggtcgagtcgctgctgggcaggttacgggtgccgccaccgttgagcacgctgggtgtggctggcgtgcagaattgcttgatcagccgcttacccgccgtatccttctgaacgtcaaggtcaagagccgcaccgaccgcatccaagctcatcggcagaccgagttaagccgaccacaccatcgtgcagcgccactggctcgggtcaagaaacccggccgccaacagctcggggtgatgacgctgcagccacgcggagagcgcgacccgctcgaaggcggcgttatgcgcccacttgaccacgcccgggtccaccaatgctgcgagcacctcgtcgggcagcccaccaccactggcgagatcgacgacttccaccgggccgccgtcgatcgagtagccgaagatgaggaggcggaagtcggggtgttcggcatacgggtagacgccggttttcgctaggggtgctgggctgaaggtttcaatatcgatagcgatctggcgcatcagggctcctggacagtcgggtaggcgaaggtgagggagccaaccggtgtttggtggctccctcactgctggggtgctacttcgggtcgaggttgtaggtggcgttcatcctgtcgagctcggccttctccttggcgatcagctcatcgatgcgctgacgttcgcggcgtttggcccgcttgtccttaatccagtagtagccccagaccatccagaacgggatcaggacgtagacccacacggcgagggtgatggcgttgaaacagtcactcatgattcagcctccttagttgaggaagtcgtcggccggcgcgccgaagtcggactcagcggagacgcggcctgcgccaaggggttcaccgtcgcggatcttctgaatgttgcccagcccgcacgccacacccttgttcccgttcgtgttgaacgcgtagaacgacagggagacgcgggcgtagcaacccgagtacacctcggaacggtcaaggatcggagagacgttctcgtccacaacctgcggcggagtgaggctgttggcgttgacgaagaagctgtttgcgtaggcttcgtcgtcacgctcggtatccccgtcacgcagcggcagcttcagagccgccttgttggagcgcttgcctccgaacttggccgtaccagcgtcgatcgccgcgtcgatggccttctcgatagctgtgatggtggtggtgtcggccttcgggatgatcagcgacacggagtacttgggcttgccgccctggatggagttcggctcccacacgtgagcgtaggagaggcggacttcgccggtgacgacgcgggtggggttgttggttgacaaggttgttacctgctttctgttttcgtgaattcggtttgtgcgctgtggatttccagcgcgggtcgtttgtcggtgtcagacacgagcgtcggcttacccacgggcttgaccacgaggtcgccgagcacctcgttgaaggtcttcttgtccatgagccgttccatcgcagtgagcgtgatgagtctgcggtcgtagatgtcggcgtacccggcagcttcagccgcttcggcgacggcgttctcctccgtgtacttgcggacagaccgtccggcgacgagcttgaaaccatcccagtgcttgccctggttcaccgcctgcgagagcgcgtaggcctccacatccgcagcccacgttttgagctgtggaatccttgtcagcacgtccgcaatctcgctgccggacagctcggccggtggggcgaactcgtgctgggcgagcgcgaggttggcttcggcgcgtgctcggcacgtcggtgcgatgcggcagaactggcaccacgagccgggacagaactcgcccccgcccgccgcagccaactcggccttcggcttcacctcggtctcagcccatgcgaggaggtcggcgacgctggtttcccaagtgtcaacgttgccccgccggggctggtagatcgtcaccgcaacatcggtgatgtcatacaagtccccgaaagcgtggacggctccgagcgcgtacaacatgagctgcgggttgtgtgcggcctcgacgaggatgccctgcccgtacttgagatcgatgatctgcagcttgggttcggcgatgatcacgcagtcgccggtaccgaaaccgcccggcacgacgtgggagaagtcgaggcgctgctcgatcagcacctgcggatcaccacaggcctcccgtgccagtgagatgtgttcctggacgaaggcgacgtagtcgtcggtcaggtcctccatctcggtatcgatccagccggactcgggcttgaaagtcggcgcgtcgttcagggcacgccggagcttccactccgccagggcgtgtgcgacggtgccctgctcggccgccgccgacgtcgagtccggctcacgggattccagcaccgcgctgggtgggcagttcagccaccggtgcgcgcccgacgccgagagcagcgcatgctggtcaggcatcggacagctccttcgccttggccagcagccacccgtacttcgtcgggtcaaccgccgacagcttgtccgcgccggtggcgacgatcagctcacgcacctgctcggtcatgccttggctggagagcccggcgagcactccacgcacctgcgccagcgacaccggctccggctcaggtgccggttcgggtgcctgtcggtgggcggcctcgtactcagcggcggcctgctccaggtcgggttgtgcgagcccggcggcggcgatcggacgagcgccgggcatcccggcgtgatcctcgaacccctcccacgcggtctcctcaattgcggcggcgagcatggtgacacctgccgcgtcggccagcgccatcaggtcgtcgtcggtgtcggcgacacgcacctcgacggtggaggcttcggagccgggcaggagcacggccatgcggtgctggggtcggctggtgccgaagatcgcgcgcagcatccgcctgctggggcggatttcttttgcagcgagtgcggcagccgggctgggatgcttggcgatcttgatcttgagcttggtgggcatccgggtttccttccatgtgagtggtggtacgccccatcaccgggctggtgaagggagtgccttgcatctgtcaggcatgggacgcaccgaaaccggacggcctacgactcggtgagtgttttgcgcagttgggccagaccgcgcgagacggctttccgcaccgcatcggcactggtcggctggcctgcgccggtcttgtcggcggcgatctcggtgaaccggtcgccgtggagcacatgcagctcgatgtactcgcgctgcgtcgcagtcagcggactcagcagttcgaccaccgcgaggttggcctcgacctgctcggtgaagtccggatcgtccgaggcgaagtaatccgcgcccagcccgccacgctcgtcgtcatcaccgtggccgggttggtcgacggagatgtcggagcggcggcgattgtccagctcgcggtactcggcgtacacgtcgtcgaggtaggcgcgagcccacttcggacgcgaagccgggtcgcgcagctgggcacgcagttcttcgctgtcgggcaggtcagggacgggtaggtcgatggtgttgcccctgggggtcaggtacgggacagtgaattgtctgttgaatgccacgtgagggcttcccttcttgcgaagggagaccccgttgagggcaaccgacgagagaccgtggtgttgagcggaaacagtgacgggcaccaacccgacccgggggtgaacccgggtacaggtggtgcccgtcaagcgctcaacggaggtctcccgaatacggttgaaaaacgcatgcgggtgtaggaggaaggcggccggccggtgaccggtacggctttgaccgccacagcggttgggctgtcctgccggatgacgtctggccagcaggacagccgtgagggctacttgcccttacgcggcttggcctgagccagcgccgaggctgcgaccgacttcgtcttggccgaggtgcgaccgtcgcgcagcagtgcggacgccttcttggcgaccggtcgagacgtctgcttcgtgtttcgtgtatccatgtccctgttcacctcctgcctcagctcgctccgacacggttacgcgttcatgaagatgaacgcgacaagagtgaagcggccttgtaagatcgaaggaacacaggttcgctgttcgcccttgtggttctaggttccccgatgacggttttctgatcggctgggaagcgatgggcagcgatgggtcgcgatggagaggcggtgcggtggattacaagtcgagcttccacgccgtcttggcgacggtgcgcccgctgatgaaaggcacccgtaaccttggcgagttcaccgcaggtctcatcgacatgggactcgtgcctcgcggaaccgtctacggcgagaagaccgcgcttgagatgcgcaagtcggcgacgtggaaggggtacgccaacgggtctgaccagctgcctactgtgttagcgagcgagctggctgggcgatgggatcagtttcggttcgccagcaacgtctcccaggcatacgaggagtcggcactcaatgacctagccgaccggctccacgaccttgacgagtcgatcaacaagggcaatgtcaccgaaggtctaggccagctgttctacaaggtgttcaccgaagctgccggtgagaccgctgccgtaacggagcccttgactttggcagacaaggccgaccgatctggcatcccgtacattgacgagaagacgaatcgcctcaggcttggcgaccgctcggtcgcgttaccgccgaagcatcccacaccggacacagttcagcctgctgagctggggtatgtttcggcgctcctggccgcgcattgcgaagacaaagcccgtaccggcgttgaggtgcagctggacgacatcccgtcgcgtctggttcaacacttccaagaacagcgcaaagcgttctaccgtgccgaatgggtacgagaaacatcgtggaactgcatccacgatgggcggccattgtttgacgagttcttggaaacgatgcacgcgggagtctccgacaccaacttgcatcagtaccccaacggactcgaacgcctcctcgcgacactggctcaagcagccgcagtccaactcgacggtgtccggctcgaccagatcattgacctgatcgacgtgtggagccggaaaggttcctgccacgaactcgtcgcccggaaccggctgggatgggtagattgatgcgcgccacgtccctagacacaagtttcgaagctgaactgcgcgggctcatcttgctgttcctgctcggagatgcagcggatgccgactacctgggtgccctagacaccatcaccgtcaacgcccacaccttcggggtcggggcagagaacctcaacggcacccaccgactggccagcggggaactccacacgcgcacagtcctgatgacccaagctctccagcatttggcgatccaaggattcgtgacactacagccagatcgttctccggcggccttcacgattaccgctgagggtgaatcagtcgtcaaccatttccgctcccgatacgccggtcagttgttcgacaccgcgttggagacgatcgagcgggttggcgacctgagcacgagcgagctggctcagatcatcaggtcagcgaccccggaaggagaaacgcgatgacaccaggcttctggatcagcagcatcaccgtggccgggcaccccactcggcgggactccagcgtcggtttcgaatctggactcaacgtcatctacggaccgtctaactccggcaagtcctgggtgcttcagtgcatcgactacgtgttcgggctgaaagccgacgagttcgtcctcgacgaaaactccggctacaccgaggtgcgtatgggggtgcgcaccgcgcagggctcactcacgttatcgcgccccatcggtgagggagccaataacatcgaggtctccagcacagacccacgaattgagtctggaacctacaaacgtcaatcgtctggccgttccccgctactcagctcggtgtggctcaaactcatcggctacgacgcccctgaaaacctgaaaatcatcaagaatcaaaaccttgaaacccaggcgttgacgtggcgcaccttctggcatgcgctgtacgcggatgaagaccggatcagcaccaagaaaccaatccttctccctcttcagaccaccgcacagcccgcgttcaaatgcgccctagcgtcactgatcaccggcaaggactatgccgcctacgctcgtgatgagtctgtcgaaacgaggaaattgcgtaacaacgcgatcatcgactacctcgagccgctacccaaacagcttgaagaacgaatcgagttgatcgacaaagcactcggtagcagcgacccagcagagatccagcagcgcatcgatgagctgatcgcagaactggaacgtgtccagcaacgcatcacacacgccaccgtgcaggggcaagacgtcatcgcacgcctccaacaggtgcgtgactcgctggcggaatcccgcagtctgcggaaccgatacgaggaacttgccgcctcctaccgtgcccgcatcgagcggttcgatttcgtcgaggaaggccacgccctcaccgcacacagggaaccggcaacaacctgccccgtatgcacgcaggcactaccaccggaagcgcgatccgcagttccagagcccgatctgcgtgaacgccacgacctagctgcccgactcaacgatcttcgtcaaacgatccatcagatggatcttgaacaggcaccactgcaagaacaagagcaggatctcgccgcagaagccgagcgcatcgcccggcgcatcagcggcgagttagagccgcaactgcaagccctctcgacttcgcttgccagccacaacgcgatcatcgccatgcaggcagaaagagaacagcacctcgaacgcaaacaagccatcgaagacgaacttgaagaacgcaagaatcgcacattccccaagggcaacttcaatccgctcgacgaatacccgaaaacgttctggccgcagatgggcaccaacctgctcgacatccttggagcctgcgcgttccccagactcaaagatgcccgattctcgcgtgaactgttcgatgctgtcatcaacggcaaaaccaaagcggaggaagggcagggctaccggtcgttcgtcaacaccgctgtcatgctcgccctccgggaatacctcgcctccgaggacgccacacacaaccccggcctgctcatcatcgacaccccactactggggctcgacgatccacagctcgaccccgagcttcaagaagcccgtgaaaccatccccgctgccctctacgactacctcgccctcgaacaagacggcggtcagatgatcatcgctgacaacaccaagttcatgcccgacatagaaccactaaaggaccgatgcaaactcatcgtattcacgaaacgcgaaggagaaggacgctacggcttcctgctcgatgcccaggacgaagacctgatcgatctggaggaaacagatgacaactaaccgcgccttcagctacaagcccctctggaaactcctcatcgaccgcgacatgaacaaaatccaacttcaagaacgtgcaggcatcagtccagccaccctgtccaaactcggacgcggcggcaacgtcaccaccgacgtccttgcccgcatctgcgaagcactcgactgtgacatcgccgacatctgcgaggtcgtccccaccgacctgaagggagagaccgactagatgaccgctcaacgcctgcagctcacctggtacaacaaggacaaggctctcatccccactgagaccggcaagtacggctacacgtgggttgacccctctgatccgcgctactgcgaaacccacaccctcgtgctggacgactatgtgcaaggcagccagacaccgaagtctgacgagttcgcctactccgagcgcgctgacctggagccccaggatgacaacctgctgatcttgggtgaatcgggcgatgtcctcgaagccctcacccgcgtgcccgagcttgccgagaagtacgtcggcaaggtgaaactgatctacatcgatccgccgtttaacaccgcgcagacattcgcttcgtacgaggacaacctagagcactccatctggctgaccatgatgcgcgaccgactgcaccacatgaagaagctgcttgccgacgacggctccatctgggttcaccttgactacgcggagaaccaccgtatgcgactgctgctggatgaggtcttcggttgctcaaacttcattgccgagttcgtgtggcagaaagcagactcgccgcgaggtgacgctcaacgtgtttcggtggatcaagatgtgatcctttgctatgccgcgagtggaagcacagtcatgaatcgtatggaaaggactgccgcagataacgcccgcttcagtaatcctgacggcgactctaaaggtgtttggttcagtgataaccgctccgcgcccacaaacgttatgtcttggcagcaccctagcacctttgcaattcagcacccaatcagtggcgagatgatctacccggccaagggtggatgctggcgttttggtagagaacgtctccttgagtcattgaacgagtacgcggagtatgcaagcggtgatgtagacattgcggctcgggttgcaaacacatcgcttcggtcagatcaggttcgttcagacattcctgacctggtattggtcgaccccgcttcagcggctcaatgtgctcgcacaagaattgatgatggaaattggccagaattcttcgtgactgcaaccagcttcggcagaaagtcctatcctcctaatgaaggtcagcctgcccgttcatggtggcctaatgatcaggtgggacacaatcgcgaagctaagtcagaaataaaggctctcttttccggtgcgacgcctttctctacccccaagcctgaacgtctcctcgaacgcatcattcatatcgggtcgaacccgggcgacattgtgctggatgtgttcgctgggtcggggacgacggcagccgtcgcgcagaagatggggcggcgttgggtgacgtgcgaattgctggagtcgacgttcacaacgtttacgcgtccccgtctggagaaggtgctcaacgatcaagacccgggcgggatcactcggactaagggcgaacgagtcgacgctacggaagacgggctgcctgatggtgtctcgccggaggacgccgcgaaattcacgagcgtgctcaacaagctgatcaaggacgacccgaaattgaagaaaagcatcgaggtgaagacactgaaggctgcctcgaagaccagacgcacgaaggaagtagtgaactggcgtggtggcggcggcttccaggtcgcccatctgtcgcctgcgtgtttcgactacgcccctgaactggaccgggtgatgctaactgcggccgcgaccggacagactctgatcgagtcggtgactgccaacctcgggttcacactgttgcacccggatgatgactatatttttgatgcccgccgtggcaatgccttgttgaaggtggtggagggtgtggccacgaccgagatcgttgactggcttgcttcccaaatccagcccggcgagacaatcgtgctggccgccaccacggtgatggacggcgtgcgccagcatctgcgcaaactggtgaaggggtcgcgggtggtcgcattgcccgatgatgtgtttcggtacagcgaaggtggtgaccagtgatggcgaacaggctcaacatcagttttgactccgacatgctggagtcgatcagtgccgagttcgacctgcgtgctccgaacaaggaagcactgcgccagctggtcttcactctcgacggtgactatgacccgaccgtgatgcaggtgctcaacctcgctacgggcgtgggcaagacctacttgatggcggcgtttgtggagtatctgcgccgccaaggtgttggcaacgtggtgattgtgacgcctggtaagacggtgcaggccaagacggtgcagaacttcacgcctggttcgtcgcgctacattactggttcggcgcttccgccggaggtggtgactccgcaggattattcggcgtggatcgcgcgtcaaaacggcccggtgcaactcgcgttcgggcgagagactccgatgttggcattcattttcaatattcagcagttgattgcccctaagtctgatgagggtgacactttgggtggtacgcaggatgcgatgcggcgtaagcctcgccgtttcgatgagaacgccggggtgcttttcgattatttgaagggtcttgatgatctggtcgtgatcgctgacgagtcccacctgtacgggtcgagtgcggtggcgttcaatgcggctttaagagaactggatccggcggcggcgattgggcttactgcttcggtggataagaaaaccgatcacgtgatctatgagtatccgctgtatcgggcgatccaggacaaatacgtcaaagccccggtgttggctttccgtaagagtgggtatggcacggacgaggcctctgaggaacagcagttgcgggatgctttgcagctgcgggcgatcaaacaagcccactatgatgcttatgccgccagtgaaaaccgtgctcacgttaacgccgtggtgttcgtcgtgtgttcggacgtggaacacgctacccaagtagcggagcttttgcgtaccccggaatatctcgggcgtgacgaggcagtgttgcaggtggactccaaacatgaggacgagctgacgcagcgccgcttgaacgagctggacctgcccggctcgcccgtgttggcggtggtgagcgtgaacaagctcaaggaaggctgggatgtcaagaacatcgcggtcgtcgtgacgttgcgggcgatggcttctgaggtgctcactcagcagacgatggggcgcgggctgcggctgccgttcggccggtatacgggtgtgtggcagatcgaccagctcgacatcatcgcccaccaatccttcaccgagctgctcaacgccgagaacgtgctgcagcagttcggcctggacgaagccatcgccgagcccgacaaagccaaggtagaagaggcgatccgtaaagccgccgaagagtccggcacgggtacaggtacgcccacgaccggcggtgaccaaccaacgacgacaaccggttctgaaccgggcaccggtgtcagtggtgaggtcgccggtggtgtggctccgcagccgggcaccgttcccgtcggcggcagtgattccccgggtgcgggtttgcccggtatcggggttcgcaccatcaccgaacaggaggatcagcccacctgggagttggtttcgatcggacggaacccgagctttgctgacgtgtcctaccgattcccggtgacgacgatgactgtgcagcagccgcccattgacctgtcagaaatcagtgacgccgagattgagcaagcggcgcgtcgggtcacctctgctggggacgtgctgctgcgcaaagagatcatcgccgccctaggcaagaaactccgggcagaggatcgagaaagcgccgaagtcgactccgtccacgtcgacgacgacgacgccgaggaggcgctggtcaaactagtgatcaacatgtcgctggtgcccaaaaccgaacagaccgcccgctacgtcgccacgttcctggtgccgaagttcatgcgcaccgtgacgttcaccggctggaccgtcaaatccctcgactccgcccgcgccgaactcctagcgctgatcaagaactacacaaccgagacactgcgagccacccgcgaggtgccgaccatacaccccaagtcgatgccaggcaccggctacacgctcccgttgggtgagaaggtgcatgaccagatcgagagtcgtgaccagttcgtgcgaggccgggtctacggcggctggttcaagtcgctattcgccgaggagtccttcgactccttcaccggcgaataccagcttgctcgcctgctcaacacgtcgccggggatcgtgtggtggcatcgcctgcatccgcaagaccaggcattcgtgtactacaacgcgaaagaccgctacttccccgacttcgtagccttggacaccaacggggtgcattggatcatcgaaggcaaggacgagcgcggccgcgatgacgccagggtgcaggccaagcgtaaggctgccgaggcgttggtgcgccggttggtggctgaggatgcctacgccggtcagcactggggctatctgatcgcctacgagcaagacaccgcccgtgccgactcgtgggaagacctgaaagccttcgccagcccggtcagcaacgccctgtagctgcgagttcgcctgggcgcatcacggggctccagcgttgcgggaggtcgagggtgacggcctcgccggtgatgaacacgaatccgagcctgccatcggtgagcatgcagccgccctccagcatggcaaggaagtccgggatgtggagcgcaagctgggtcggcgattcggtcaggagcttgtcgatcgccgtgtggagcgtcgatgggcgtcgccgcgcacccgttgactgcaggctgtccacggcctggtcaaccgccgtgctgttgcgcccagcgagcacctgcaacgcctcggccatcttcaccagcagcacctcctggtagaggtggctggtggtgcaggtgccgcgcttgacgtagttcgtggggcactcccacacgtcgacccggttcggggtaccggagtgccaggtcttgtggccgaacggccgtccgcagtcgccgcagacgatcttgcgggacaggcgcttgccgaaggacttgtagccgcgtgggtcgacgcgggtgcccagccacggcaactcgcggtctgcaatgccgagagcctcggcggcgtggcgttgggcgtggaatgcgtccatccactcgacggtgtacccggcggcgagattttcgaggaggaagctggtcagccggtaggtcagtcgggcttgtactgttgcgagttcggggtattgcatggtgggggctcctgtctttgcgtcacgtacatacacgctctgatcagggctaatagcaagtcgtaaacggcgataccttttagcgcttgccgaactatttggcgctccgttgtcagcctcgacgcacgtggttcacgccgccccacagcgcctctcggacaagccagccaccggagccgatccgtccgaatatgcggctcgacggtcaacactaaggcgcgttttacctagtggggagcgggtttcgccccatctgcgtcatccgcgcaccacaaacccctgtatccacttcgatacagtctgc

SEQ ID NO: 69 - DNA, 27846 bp, Propionibacterium acnes
ggtggtgccgaagaagaaggaatggccccaccaatctgctggtcggtagaagtacggggtttgagccagtcgagtagtttcataatctgctccttgcaaggtattgtgaaggatatgaaatctcttacccctcatttgcttctctgctcttttttcacaagcattgctcctgccttaggagaaggatttcgcaacaaacgtgtggctttcattccgacagcagcagcccacgaggagtacacagcctacgtggattcagcacgctcatcatggaaagaacttggcagcaatatcaccgatgtggatattgccagaatgcctctaagaacagcgaccgaggcgcttgagcaagccgagataatctatctttcaggagggaactccttctacctcctcgattgcctacgctcaacagaaatcgaccagattattcgagggcgtctggccgaaggggcgattctagttggtgaatcagctggagctatagtttgtagcccaaatatcgcctacattcagccaatggatcgtgtccctgacaactacagccaggctgactacaccggactgaacttagtggacttcttcccggtacctcactacctcgcccctccatttgtgaagagttccaaggaagtagtcgcccagcacgctagcctcccactcgagctcatgaacaacgcagaagcggtaatagtagagggtccccaaaggacaaagatctcatcagagcaccagtagtcctcgtgagtcgtacaccgacgtgcccgtgtggctgccaccgcctcggatagcgcggtcgagggccatgatggtggcgaccacctcgtcgatcttctcggtggacttttgcttgtcgggtttgatgtttcctgccgggtcggtgcggacgtgaatgttgtcgaccatccaggacagcactgggtgcctgccgtgagcgagcctaccttctagtgcgagtctcatgagctccttggacggtgggctcatgtctttgaagccttgcccgaagggcacgacggtgaacccggcatcgtcaaggttttggctcatctggactgcgccccacctgtcgaaggcgatctcgcggatatcgaagcgtgtcccgagttgctcgatgtggcgttcgacgtgggcgtattggacgacgttgccctccgtggtctctaataagccctgttggtgccacaggtcgtagggcacatgataacgcgccacccgcaacgccaggttgtcctccggtatccagaaccacggggcgatccggtacttcttcgtccccgtagggtgggaagatgaggacgaaggcggtaatatccgtcgtagaggcaagatccagcccgccgtagcagcgtcttccttccagctcgtccaggtttaccgggtcggctcccgcgtcccagatgtgcatgggcatccaccgcaccgactgcttgacccactggttcaacctgagctgccggaacgtgttctcctcggcagggttctgccgggccgagttgcacgccgcgcgcaccttgtcgatcggcaccgtcacgcccagtgaggggttggctttgcgccacacggcctcatcggtccaatcatcatccgcgtcggccccgtagatcaccggatagaacgtcggatcatacttcttgcccgcgaggatgtcctggactttctggtgctgctcatagcaaatcgaatgcgtatcagttccggcggtggtgatcaggaaatacagcggctaggtgcgtgcgtcgcccgaacccttggtcatgacgtcgaacagggctcggttgggttgggtgtgaagctcgtcgaagaccacgccggagatgtcgaacccgtgcttgaagtaggcctctgcggagaggacttggtagaaggagttggtgggcttgtagatgattcgcttctgcgaagagaggatcttcacccgcttcgacagggctggtgattggcgcaccatatcggcggcgacttcgaacacgatcgaggcctgccgccggtcggccgcacacccgtagacttcggcacgctcctcaccatccccacacgtcagcagcagggcgacggcggcggcaagctctgatttgccctgcttcttggggatctcgacataggcggtagtgaactggcggtagccgtcggctttgacggtgccgaacaggtcacggatgatttgttcctgccagtcgatgagctggaagggctgtcctgaccagcggcccttggtgtgtttcaaggcttggatgaacgcgaccgcgaagtcggctttccgcttgtcataggtggagcctgcggccatgaaccgggtcggcgtgtaggtgtcgagagtgcgcatcacgcccgtcaggctccttcctgtgctggttagttggtgtgggcgaaggcccaggcgatggcgtggccggcgtcagcgaacagttcgtcagcctcggcgaccaggtcgagttcgcattcactgaagcctcgggcgtccggtccccagccggagatcggctgctcggcgagcttgtagacgcgggcgtcgtttccgatccggcctttgcccaagtgccggtaggccgaggcgaggacgaagtccccgtaggcgatcaccgtgccgtagctgtcggtcgccatctgcagctgctccatcgtggtcttttcgttgttcatgaccttctccttcttgccttgttcggtcatgtacatacagccataggtgcgcgctcttatccagtcgtaaaagccctagtcagcccactatttttgaggaatctttgaggggcgacgggcacggaaacggcccctgattgggtgggtacccacggtggcttggggtcagtcgatggccaggtgccaggcggggatcatgcggcgttccccggtgatcgggtctgggtagcggtcgttgacttgggtcatgcctcgcagggttgcccctgcctgggtgaggttccagatgatcgtggtcaggccggtctggttcgcgctgatcgtgaactcgccgatgctgtgctccttgagttcgtcgaggatgctgggcacgtctgagtcgtagagaccttcggcgaagtcgagcagctcgttgcccgcccgctggctgttcatgtagacggtgagcaggctcgtggacgaggtttgggtgcgggtcgcgatcttgctggtcgaggtcgtcaattgtgttcatcgcgggtgtccttgtgggtgggtggggtgcgccaggcggcgttgccgtccaagtgtttgagcaaggtgcggcggacgggtttggtgtcgtcgccgatcagaccgaggcgcagcagccagcagcgcatcgcatatttgtcgttcccgcccgtttcggcaggtttggctgaggctcttgtggcggttttggcgtggtcgatgatccgggcgatcagcaccgtggtggcctccactacctgcgggtcgggcgctacgtcgaaccaggggaactcgaccgtcccggcctcggcgtcgatgctcatcggggttgcggggatctggagtgctttggcgatgagctctcctttcgctgctagcgtcgcctccaccttccctttcgtggtgtcctcccaaccggtggtggggaacgccaacgtcaaccccaactcgcctggctcgtcggtggtgtccgtcgggaatccggcctgcgcggccgcctcgaccagcccggccacgtcggtgtcgtcgggcagatgcagcagccagtcacgatccaacatggcctcgccaatctggtaggcaaacgttggggttcccagatactcgacggtcgctcgcagctgggtggcgagaaaagcggcgagttgcttgcggcctttgcgctgcttggtgaacttgagtgtcgtcatgaccggcctcctttgcgtgttcccctggtcggagtggttttcggtcatgtacatacacgctctatcccgaccagatagcaagtccggacggccacctatttcttgcctcgatccacggccttcaccacatccaggtaggccaactgttggccgtcgcgcaggcaggtgatacctgcggcgtccccggtggcgtcggcgtagcggcgcagaatgactgaggcgtatttctcgtcgagctccatgcagtaagcgatccggttggtggcctcacacgccatgagcgtggagccagagccggcgaacgtgtcgagcacgatcgcattcgcctgggtggagtttccaatcggatacgccaacagatccagcggcttcgaggtcggatgatcagcattcctgcgaggcttatcaaaccgccagacggtggtttgtttccgatccgcgtaccacgtgtgcttgcccgtcttcacccagccgtagagaacgggctcgtgttgccactgatacggggaacgacccagcaccagggagtccttgacccagatgcaacaccccgacagcttgaagcccgcgtcttgaaaggcgcgccggaagttcagaccttcggtatcggcgtggaacacgtacgcggacgcgcccttctcacacacgcccgccatctgagtgaacgctgcgagcaggaactcgtagaacgcgtccgcgctcatcttgtcgttcttgatcgacaagccgtcagacgattcgaaggcgacgttgtatggcgggtccgtgagcaccaagttggccttcttgccatccatcaacagctcgatgtcgcccgcgttggtggcgtcgccgcacaccagccgatgcctacccaccgtccagatatcaccccgctcgacgaacgcggcagcctccagggcggcggtcagatcgaagtcgtcatcctccacctcgtcctcatccaaggagccgatgagctgggcaatctcatcgtcgtcgaacccagtcagctcagcgtcgaaatcactcgcgtccaggtcggcgatgagcagggcgagcttgtcctggtcccagtcgccactgatcttgttgagcgcgacgttcaaggctttttcgcgggtctcgtccaactcgacgaccacgcagtcgacagtggtttcaccgaggtcttcgaggactttgaggcgctggtggccgccgacgacatggccggtggtcttgttccagatgacaggttcgacgtatccgaactccgtcagcgaccgcttgagcttttcgtagtcggggtcgccgggccggaggtctttgcgcgggttgtagtcggctggcgtgaggtcagcgatgggtagctgctcgatgcgcacggggctccaccgccttccgcaggtcgcgctcaaaacgccaggtttgttcccagcgcggccaatcccggcccatgtgcccgtagaccgcgagatcccggtaacggggtgtgcgcaggttgaggacgtcgatgatccccgccggccgcagcacgaacacgtcacgtgcggcggcggtcaagatgtggtcggcgtactcgccggtgccgagcgtgtccacctcgaacgcgaccggatcagccttcccaatcgcatacgagatgcccacctcgcactcagcggccagcccggcgtcaacgatcgtacgagcgatcaggcgagccatgtaggccgctgaccggtcgaccttggatgggtccttgccggagaacgcgcccccaccatgagacccgagcccgccgtaggtgtcgaccatgagcttccggcccgtcagcccggtatcggctcgcggcccgccctcaacgaaccgacccgacggattcacaagaatttcggtgtgctcgtctatgggtaggtaggtctggcaggccggggccacaatcagcgagcgcacctcacgctccaacacggccagatccttgcccgcctcatgctgcaccgagaccacgacggtctcgacggcggcgggggtaccggtgtcgtcataacgcacactcacctgggccttgccgtccgacttgatcccgcagatcgtcccctcgacctgggcagtatcgagacgctcgcagatgcgatgtgccaggacgagcgggagcgggaggcgttcaggggtctcggcggtggcgtaaccgtagaccgtgccctgatcgccagccccctgcaacgcgaacgccgaactatcaccaccgcgtgcctccagcgaggtggtgaccccggcgttgatgtcgctcgattggcggcgcgtccacacgtagatcaggatcccgagcggactgtatccggcacgcgcgagggcggtgcgcacagactcccggatacgcgggcggtggttggtggtgatttcgccggtgacgatgatccgccgaccggctgccatcacctccaccgccacccgtgcggccttgtcgtcgtagaggatgtcgtcgaggatctggtcggcgatctgatcggccaacttgtccggatgaccagcacacacagactcggcagtacgaatcgaacacataagcacactcgcttccacgaatcggaggggaacaagaaagcgtccaccccactagagggtggacgcgaagatcatgaggggcggttaggagcgggcgttgagcagctgctccatcacctcgtcgccgggcgtggtgcccgcgtagtcggtggtgcaggtggcgcgcacgatctcgtaaatctcgtaccaatacacattcgcctgcttcccgaaactctgggacatggcgacaaacgggctggcgatggcggcaccggtggtggggtgcttgccgagcaggccgaacttggagatcgcctgctcgcactgcacataccgggcaaacgcctgcgcatacgcctcaatcaggcgaggcgccacgaattgggaaccgccacgttgatcgagccactgccacgtctcccgatagacgaggtcagcgccaagcggtttgccgtcacgctgaatctccgacagatagtccgatggttcgggcatcgtctccccggcaagcaccgcaccgtcgccaatgtcattacctgcgaagtcgaagggttcgttgagcgggtcttccaggcgggtggcggggcgtccggcggcgagtttctcgcccagcgggccgggcttcgcgcctgcacgcacgcggcgtcggcccctgttggtgccgtctttggccatgggtcgcctccccgccgtagaatcgtcatggtttcggtgctgaagtccacgggaggtgtgagtggttgagtctttaaaactattcgttcggacctacgtgtattgggtagggctcatccttggcttcgcgatagtgcccggttctctgctcttcactgctgaagtcgccccggtgaacactccattgtggcttgcacctttcgccgggctgctgctttttgtcattgatcggccatcaacatgggagccgccgctctggcgagcattactgatccgagtattgggtgcaggatttgcagccaccatgctcatcgcgtttgatgcagttgcttccacccactatggatctcaacactggagtgagacgctcctatctttcggtctcggttggattgtcttcacggtagtggcaggacacatgctcatgagcagctccgcccgatttggcacacctgctcacacgatcagggacgcgatccgtacctacacgacatggataggaatctgcttcgggattttctatatccccgccgcgggactctccgcagctggcactcttttgatggttcttccgctttatggaacgttcctcgccggcctggttcttttgatagttgacccgccacgacgatggccgcaaccgcgagtgaaggcactgtggatacgactcttgtcaagcgtggcagcagcattactacttgttgtcacgaactcgttctatcgcagtactcgcacacacgagattttcgtcggggactggcaggaaaacctggtcttcttcgtgggtgcttgggcactttatgccgcagtggctggggccaggtatcttacgcctggccccagccacgaagcagatgacaaactcagtagatgaattcagctagagcttgacatgctgccctcttggtttcttcgctaggctcaacgcccgagtagccgtatgccccattggaaccgtctgtgagaaggccaacgtatctgtcatccaatgggccatcaatttctgcaaagaacttgtcctttgcggttcctccgtcgcttgcaccaacactctcagagatcgccttgaatcgctgcaatagcgaaactggattgttgtagtagctcctcagcgttcgggacagaaggttggggtcgtcggctcccgagcctttcagcatcgcagccagtttgatcgcatccccgtcgctacacaggtcggagtagttgcagttgttcggcagatcattggggatggtcaaaccttgaagtccgctgtgattcttatagttatccccttggccaacaagagcccttgctattgcaataatgtttgagccgggattcaggtcaacaaccttttgaatcggaccgagcgctgaagctaagtcacccgcccatcccgtccacttatcaggaacgagcgggttgaggttgatgtagcccagggtggtcacgctcatatgcgggatatctactgcaccacctgcggggtccgtccattcttgtcgatcggagcgaatccacttattcaaggcagagattatctgagacgcttgagtgtcatcttccagccttttcgcgtccgcctcccgatatgcttcagctgccgcggaccactttgcgcttcccttgaggtagaccgttgataggtagttgaggacacatcgccaagtcggaactttgacccaagtaacgtagctgccggatgtgatcggatcctctccgaaagcgtagtccttatagaccacgcgcaattcctcgaaccggctctcaagcgcttcgatcagatcgagaaaatctagagcgtcgtaattcactggctgcgcgtggcgcaccgacgaatcggctgacatgcgacccgaatatgccacgcggtcaagatcccatttcccccgatatccactgatttcgtggaactgatcaaatacccagttgtcggggatggggaaaccgagattacctgagaatccggtagacatgtcagaaacgaatgatgctaccgcgtatccagcctgagctatccgggtgcagatgtttcgcgaggcgtagatacccactcggtagccgccgccgaggctttgcgttactgccttgaagtagggcaggatgtggctggtcacctgaggatccgtggcatcgtagtcaacggcgaagtagatcactgtaggtggaacaccaagtcgttgggcagcggtttgggcctctttcgcatgacggtgcccattttcgacactaaagtacttaagttcagttgagtactcttgaaaaattgggaaatacttcagcccatgaccaacgattcgctctagctcgcctgtgcggagcgccttgaaatagtctgcctcagacttactgctttggttgggttcactgagatagcggcctacgatctgataaccatcagccttaagatgtccagcaagctcgtcagtgatctcaaagcgcgtatcgcaagccacacatggccgattggggtcgcctttagaagtgagcaggctcatccatgtggttgggtcgaccaccccggtcactggcaaggcgtgtgcttgctggaactgccacagcgtgttgctgatttcgctgttccacgtgctggtcggcaaaatggagtagccgttgcagaccagactcacagtggctagccatacccactggttagtgccgctactaattgtccgtagtttggagcgagtgcctgcaccaaaattcccggtggcttcggcagttgtgtatccttcgattgcttggaggacctggattaaagccgtgttcatttcacgcccgtacaagccatcagtgggaatgatccctgtgtagttcttgtacccacggttaatcgcttgctgtgcctgacgaatagctgtcttgccgccgtaggcagagagtaaccggaactgtttcattgacagaagcgccatcattagttcaacatcgaccgttgcgctcgtatcgccaaggccaatatcgactttcatctggcgaatagagtcggccacgtggtcggtaaactcaagagtgatgccaccgtattcggctcgatatcccttgcaccacaaggctccttgaataatcccatgaacattgtcgtagccagaagtttgagtaatgccgtttggccaacgagacttgaatcgagactgtgttccagaaccgaaattgtttgccgtcgctgtaatacccagttcgatttgcagagcgcggatgagtgcgttgattgtatcccagccagtgttaccggtttcttggactgagccgaacccagttttattgccgtaagtcgaattcagccactgctgagttttcagcaccatttgatctgccatgattcctccttcagaaatcagttgttaactcgaggcaggcgaacacctgccacggaggggtccagaacaccggatgagaagctccgagttttttgccctcgcctgtacgtcaccgggaaacccgaatccggacggcaagagcgaaacttcgcgagtttcatccctcactggtactgccgacgaagcccgaagtgttaataccctgtttgattctgggactttgcgcgcggttggccccgcccgctgacctgtccgagcgtcgtagagatcgagaggccccaaccccctcgccagcgccgccaggttcccccgtgtctgccgatcagcaccgaggtgggcatctttgaggtttcgcaacctcggcgcgacgtggcgcgacgtggcgcagatttcagtaggtgtagatcctcggggtctgcctccaccggtcgccgtcgagcgccgactggcgggagtggcacggcttacacaaactgcggaggttggcctggtcatgggtgccgccgtgctccaacgggatgacgtggtggacttcctgcgccggggtgtaccggccagccgcgaggcagtcctcgcacaaggggtgggcggtgatgtaggcggtacgaatcttgcgccagcgggccccataacgtcggttgatcttcgggtcacgctgccacttgcggtagcgctcgtcctccgccttggcgtgggcttcgcagaagcgggcgtgggtgaggttcgggcagccgggctgggaacacggacgggcaggcttgaccggcatcacgcacccctttcccggacacggcaaagccccaaggcacccagccgatgaccgggcttgccctggggcttttcctacttttcaaccacctacatcattgcaggcccgaaaccctaaatgcatccgcagttcttgacaccttttggcggctaggttcacgcggcctgcccatacagcgccgacgccagccgggcgagcgcccgagacttcttctggtaggcgctggtgcgctccacgtagaagtggtcacacaccgtttgcaccgcctcatcctgggtaccgtcgccgaggaagaatgcttcgagcacgaacctgtcgtcgtcggtgagcagctgccaggcgggcaggaaccacgccatgtactcacgcgcctgggcgtaacgggcacggtagatgtcgatccgatccaacgtggccgccacccgcatctccccagcatgcagatccgtgtggcggggcatcccgtcgagtttcgatgaggctggggtggtgacgtcgtcgtaggcggtcttgatctgctcgtcggtggtgtcgatgatctgctccatcacggcgaagtcctgcaatgcgctgatggctgctttgcgggtgtcgaggtatttggtcatcacatgcatgacgactccttcctgcttatggttgtgagttcggtggcgaccgcgtcgatcaatgcggcctgggtcatgtccttcgcctccagcgccttgaggacggcttggtcgagggtgccggtggcggtgaggtgggtgatggtgacaggctcggcctgtccttgtcgatacagccgggcgttggtctgctgatacagctccaagctccaggtcagcgagaaccacacgagcaggtggccaccggactgcagattcagtccgtgcccagcggaagcggggtggatcaggccaagcgggatgtcgccccggttccacgcctcgatgtccgccgacgtcttcagttcgcgggcttgtgggaagcgacgctggatgcgttcgcggtcgtgtcggtaccagtaggcgacgaggacggtttggccgttggcggcctcgatgatgtcttcgagggcatcgagtttcgccccatgcacctcgaccgtatcgccgtgctcgtcgtagatcgcacccgaggcgagctgcagcagcttgcccgacagcgcggctgcgttcgccgcatccaccacctgcccatccagatcaaccaccaggtcggccttgagctgctcatacacagctcgttctccggctccgagcaccacgggcgtggtcgtcaccgtcagatcaggcagcgtgaggtggtcggtggtgcgcattgacaacgtcatgtcggcgatagcgtcgtagatttcctcctcagcgcctgccctcggcttgtacgtgaacacctgcatcccgttgcgcttatccggcaggaaccacttgtcgcggtagcgggtgatgaatctgccgaggcgttggccgccgtcgaggagccggaattgcgcccagatgtccatgagcccgttggaggcgggggtgccggtcaggccgacccagcgcttcacgtgtgggcgcattttcaccaacgccgtgaaccgcttcgcacggtggttcttgaagctggagagttcgtcgatgacgaccatgtcgaacggccagctatcgccgtactgtctgacgagccaggggatgttttcccggttgatgacggtcaccatcgccgacttggccagcgcgtcgagccggtcagctttggtgccgaccgcgaccgccaccgatagaccttggaggtggtcccacttggctacttgtgctggccaggtgtcgcgggcgacccggagtggcgcgacgacgagcacccggctgacggtgaagtagtcgagcagcagctgccagattgccgtcagggtgatgacactcttgccgagtcccatgcccaggaggatcgccgcttcgtggtggtcgaggatgaaccgcgtggcggtctgctggtagttatgcggccggtagcgcatcaagcacctccttgatgccgtccaccgagtcaacgaccagcgcggtgaagccgtgggcggccagttggctcatccggcggcgttggatcggccgaggcttcttgccgggggctttcacttcgacgaagacgacctggcctcccatcaggcatagccggtcaggtacgcccgtggttccagggcagacaagcttccagcacaagccgccggatgcctcaacggccttcttgagctgggcttcaatgtggtgttcgttcatggtcactccttgagtggtttcccacgggggtgacgactggtgacgggtggatctggacttttctaaaggagatatttttgtggccttagtaatagttcaatactgatcgtcaccggtcgtcaccctcatcgggtttagctgttgaattcgctggtcagagccagtccgtagacgtacatgccatgcttggacttgcgtcgttcaaacccggattgttcgagagtggcgttgaagtcggccatcggccgagcccacccgctggtggattgcgcccacgctcggtactcctggtacaggtcaccggcgcgttcggatagggacgggtccacctcgcagcgggcgtcgaggaattgggcgaaccagttgttctcttcccgatatgcgcttgaggcagcgaccacttgggcgggtggggcgagctggtagtcctcggcgtggatgagccgcgagccttccatgatccatgcaagtaccgctccgccggcggtctcgtagaggtggtcggcgtagttcttcacatcggagctactctcgatgaccgcgttgaacgggatcacgatgagcctgcgccagatgcccgcatccatcgcgcccaccctgggcaggtgattcgtgtagaggatgagcgtgtgggatggggtgaacgcgaacggtgccttgtatttcttctccgcgtagatctggtcggtgaaggcgagttgcttgaccgtggaggtggataggcgcacgccttcctcggactctgcggcgatgatgagctgtttgcctttcgcttcggcaagctcaggtttgacgttccggttcccgccaatggtgagcacgtcggcggacatgttgcccgcatacgtgccaagcactctcgcgatagtgttccagaacgtggacttgccgttgcggccgtccccgtaggcgatcacgagggcttcgaccatgaccgtcccgatcgctgccagcccgacgatccgctgcacatacccgatcagctcccggtcggattggaagaacacgttgagcgcccggttccagatttctgcgcccgtgtcggtggggtcgagcgcggtttgtttcgtgatcagatccagcgggttatggtcacgtcgggtgccgtcacgcacatcccacgtgccgccaggcgtgttgaggagatacgggtcagcgtccagccgggctggggtggtcagcaacatcgggtgtgcttccctcaggcaggaggtgatcgcccgggactcgcggcgtttcaacacgaacgcctcgtatgccttcgcgtcctcaaatgcccggtaggcggcccgctgcggtgaggtgaaaccgccgagtgctttcgctttcgacgatgcggctgcgagcaccgcgttcgcgcccgtcaccatgagctcgtcgcgggctttctccagcagatgcccggcctcggctagttgccggtcggtcagttcctgggcgatgccttgcgcagcaggcgcagactcagaccacacaccgccttcgtagacgagccagtccgtggcctccgtaaacgccagacgcgacgagtattctgcggtgagcatggatgcctgcccgacatcggtgaagtcctccggccgcaggctcgtcagctccgcgtaggcttccggcgacagataacccggctgcgcctcgactttggcggcgaaccggcaggcgctttgccagatcgactccaactcgtgatccgacaggggcggttcacacagggacgctttccggtcgaacaggtcacgagcttgggcggtctgcccgtaacggatcaggacgcgtccggcgaagcgggagagggtggcgttgcgggagccttccccgatcacctgcgtggaagcgtcgaacgcggcgaacacgtcgatctcgtcggcctcatccagccaggcgtcgagcagctttgtgccgttgtggatggtggtttcggggttggtggtgccgtagatgaaccgtccggcatccaacgcctgcgggtcgaagaacccgaaccgtccagcgaggcggcgcttcaaccccgcataggtgtcggcgtcggtgaccgggctgattgggaagtagacgtggaagcgaggcctggccgacagcgtccttttcggcttctggtggttacggctggtggcggtcatgaactcaacccccgccatcagctcggccaggtcatctggggtgatccactcgtcggggttgtcggtgtggtcgttgtcgatatccatcacgacacagtccgaggagatgaagctcgccgaggagcgccggtcgccggtgtaggtggcggcgacgtgatccaaccacgccacctgctccagcgaggtttggtcggtgatgtggtggtggttcgggtaatggttattgtgcgggttgccgctactcgtggcggcgcacaaggtgaacggagtcatgcgggatgcacctcctggaagtcggcgtcgaagaagcggatcgggatatccatctgatgggcccagtcgatctccgcccgcatccccgggctgaccctgccgatataggcccacagctgctcgcatttcgacagcaggatgcggttgaaaaacatcgccagctcccgggcatccgggtcggtgtcatccatgaactgcggataatgcaaatgcggagccaacgggatctgacgagcctttaccgcaaacgcacaaaaccggcgggcaagctccacgttggctgctatgtcacccgagtacggggagcagatgtagaccaatgggcggtagccgtattcggcgagctggatttctttcagcgcctggtagcaggtcgggtcggggtatccgtcggcgttgcgcagcggaatacccacatcgatggtggcggtcatcaggcgccctgaccttcacgttcgatcaccggcagcaggccacgggtgttcttcaacaggtcgtagatgaacaggcgacccttctgcgtccagtacatgtgggtgcgggtcttgccctcgtcgtactcgtgcgtcttggactgcgtgtagccctgctcggcaaatttcgcgtagaggaaccagcgtccggactggtggaactgcacctgctcctcgcgcagaatctggttaagcttcttcgccgacagcccgtagtccttggcgatctctgtggcggtgatcagtgagggcgatgccagcacgatgtcgtagtacgacaccttcggtgccgcctccaacaaagcttgctcggcggcgagccgcttggcacgttcagcccggagcgtggtgatcgcccgctccagaaactcgtcgtcagcgagcagttcgtcgatggcgtagataccatgtcggcggatcgtcggcagaacctcgtcgaacacccacgtctcgaacttctgggcggcaggaagtttggaagtgacgatcagccggtacaggtcgccttcgctgatgaacctgacctgctgaaccccacctgctgtttcaagggggtagtgattcacgactcccttgcagtgacgtgccagagcgtccttcgtgttggcgtagccgagggctgtagccacgtccttgccgcagaacaggatctgcccgctagaggtgatggttcggattgtgccgaactcgtggttggtgaacacttgtagtccggtagccatgaccagctcctattctgagagccaagtagacaatcggcggcgcggggtgcgccaggctctcacctgtcaggcacggcagacaccgaaaccggacacggcttgaggaaggctctcgcccatacgcccccgagcaccgacaaatccggacgggtcagagggcacactggtgtgtgaacgtaccgataactccgtgccccgtgctcttgcttcggcgtcatcaaccaggtagccttgtagtcaacatgaccggttccgctgcccgcctcggtgggagtccagggccggtcttcgtttttcgtatcaaacaggggtgcgcgtggagcaggtgaagcagttcaagacctacggtgaacaggtcgaattgcttcgtcagcgtgggatgcgagtgaatgatccccagcatgctgagacgctgctggcgcgattgaactactaccgcttgtccggatactggtacccgatgcgccgtttctcccaaggcgacggcactgcccgagatgaattcgttgagggagcatcgtttgacctggtggtagccctctatgggtttgacgaacaattgcgccacagcgtgttcatcgagcttgatcgcgtggagttggctattcgaaccaagctcggtcacgaactgggtcgccttgacccgctgatctatttggatcccaagcgtttgagcgcccgggcacggcagcgaaacaaagacgggcgtagcgtgcacgaggtgtggctgagaaagtaccagtcggcattgaaagcgtcgaaggaggacttcgtcgcccaccacaaatccaaatatggcgggactctacccatctgggcggctgtcgaaatcatggattgggggatgctgtcgtacctgtacggcatgtcgcccaatatcgtgcgcaaacggattgccgagccctgcggcctaactggtcctcagcttgaatcatggctgaaatccttgaatattctacgtaattacgcagctcatcatgcaaggatgttcaaccgtgtttacgacatcaaaccgaaactgaacaatggcgtcaggctggctccggtagctgaaggaatgaatcgcgtgttcgggcagctctcccttatccaatacttgcaccgccaactggacttgtctccagccgaccggctaccgaagctgttccacacctacccgcacaatcccatcgtgccgttttctcgcacaggagcacctgacaactggcgcgagttgcctctctggtgcgtctaatccttgcggtagtagtcgcattcgtacccgtcggcgtcgagtggcagtcctgctgcccagtcgggtggggtcgtcatgagctggcaggcatcggcgatggtgaagccggagtcctcgggttcgtcgatgacgatttcgtcgtggacgtgcatgacaatcttgtgcccagcctgagcgacgagtgtcatggcgtggacgaggaggtcacgagcgactgcttggacgatgttctcgacgagtttcccgccgtaggtctccagccgcccccacttgcgtccggtcgtgacaccgctgtaggtgatggaggtgccgccccaccggttctcaccaagctggggcttcacgtaggccagccgcctaccagagggcagggtgatgaacaagatgccggactcggcagtgaagcgaaggttgcgcagccgaacagcctggcgggtggtgatggcgtcaagtgcggcctgctcgacatccgcccagagtcgcacgatgttggggttggctgcccgccaggcgtcgacgatgggtttgagttcgtgctcggccagccccatccgtagggcacccatcgccttgagcgctccgacggagccgttgtaaccgcaggccagcgtggcgatcttccccttctggcgcagctcagcgttgatgccgtgtttttcgacggggacgccgaacatgcgcgacgcggtctcgcagtagaggtctttgccgtcgcggaaggctgccagggtggatgtttctccggcgagccaggcgatgacgcgagcttcaatcgcggagtagtcggcgacgatgaatcggcatccggcgctggggatgaacgctgtccggatcaactggctgagcgtgtctggcacggagtcgtagagcagttcaagggcgtcgaggttgcgttgtcgggtgagggtgcgggcttggtcgaggtcgggcaggtagttacggggcaggttttggacttggacgaggcgtccggcgaatcggccggtgcgtcccgctccatagaactggataaggccgcgtgccctaccgtccgtgcctgtgacgttatgcatcgcctggtacttcttcaccgagcttttcgcgaggtcgccgcgcagctccaggacttctttgaccttgcccgtggcggactcgagggcggcttcgacatcagccttcgccaaggacgacatctcgcagccgtgggtggtgagccattccttcaactggatcggtgagttcgggttctccaacccggtcaactcccgcgcccgcgccaacgtggcggcacgatgctggtcgtccagggcgacggcagcgtctgcgagggtgtggtcgagcaggatgccggtgtcgttgatgcgttgatccagggcgtaggcgtcccactcggcttcgggaatcggaaacgatgagagccggtcgtggatcgcgagttcgacctcgacgtcgcgctggttgtagtcgatgaactgagcccagctggtcgggtcgctgctgggcaggttacgggtgccgccaccgttgagcacgctgggtgtggctggcgtgcagaattgcttgatcagccgcttacccgccgtatccttctgaacgtcaaggtcaagagccgcaccgaccgcatccaagctcatcggcagaccgagttaagccgaccacaccatcgtgcagcgccactggctcgggtcaagaaacccggccgccaacagctcggggtaatgacgctgcagccacgcggagagcgcgacccgctcgaaggcggcgttatgcgcccacttgaccacgcccgggtccaccaatgctgcgagcacctcgtcgggcagcccaccaccactggcgagatcgacgacttccaccgggccgccgtcgatcgagtagccgaagatgaggaggcggaagtcggggtgttcggcatacgggtagacgccggttttcgctaggggtgctgggctgaaggtttcaatatcgatagcgatctggcgcatcagggctcctggacagtcgggtaggcgaaggtgagggagccaaccggtgtttggtggctccctcactgctggggtgctacttcgggtcgaggttgtaggtggcgttcatcctgtcgagctcggccttctccttggcgatcagctcatcgatgcgctgacgttcgcggcgtttggcccgcttgtccttaatccagtagtagccccagaccatccagaacgggatcaggacgtagacccacacggcgagggtgatggcgttgaaacagtcactcatgattcagcctccttagttgaggaagtcgtcggccggcgcgccgaagtcggactcagcggagacgcggcctgcgccaaggggttcaccgtcgcggatcttctgaatgttgcccagcccgcacgccacacccttgttcccgttcgtgttgaacgcgtagaacgacagggagacgcgggcgtagcaacccgagtacacctcggaacggtcaaggatcggagagacgttctcgtccacaacctgcggcggagtgaggctgttggcgttgacgaagaagctgtttgcgtaggcttcgtcgtcacgctcggtatccccgtcacgcagcggcagcttcagagccgccttgttggggcgcttgcctccgaacttggccgtaccagcgtcgatcgccgcgtcgatggccttctcgatagctgtgatggtggtggtgtcggccttcgggatgatcagcgacacggagtacttgggcttgccgccctggatggagttcggctcccacacgtgagcgtaggagaggcggacttcgccggtgacgacgcgggtggggttgttggttgacaaggttgttacctgctttctgttttcgtgaattcggtttgtgcgctgtggatttccagcgcgggtcgtttgtcggtgtcagacacgagcgtcggcttacccacgggcttgaccacgaggtcgccgagcacctcgttgaaggtcttcttgtccatgagccgttccatcgcagtgagcgtgatgagtctgcggtcgtagatgtcggcgtacccggcagcttcagccgcttcggcgacggcgttctcctccgtgtacttgcggacagaccgtccggcgacgagcttgaaaccatcccagtgcttgccctggttcaccgcctgcgagagcgcgtaggcctccacatccgcagcccacgttttgagctgtggaatccttgtcagcacgtccgcaatctcgctgccggacagctcggccggtggggcgaactcgtgctgggcgagcgcgaggttggcttcggcgcgtgctcggcacgtcggtgcgatgcggcagaactggcaccacgagccgggacagaactcgcccccgcccgccgcagccaactcggccttcggcttcacctcggtctcagcccatgcgaggaggtcggcgacgctggtttcccaagtgtcaacgttgccccgccggggctggtagatcgtcaccgcaacatcggtgatgtcatacaagtccccgaaagcgtggacggctccgagcgcgtacaacatgagctgcgggttgtgtgcggcctcgacgaggatgccctgcccgtacttgagatcgatgatctgcagcttgggttcggcgatgatcacgcagtcgccggtaccgaaaccgcccggcacgacgtgggagaagtcgaggcgctgctcgatcagcacctgcggatcaccacaggcctcccgtgccagtgagatgtgttcctggacgaaggcgacgtagtcgtcggtcaggtcctccatctcggtatcgatccagccggactcgggcttgaaagtcggcgcgtcgttcagggcacgccggagcttccactccgccagggcgtgtgcgacggtgccctgctcggccgccgccgacgtcgagtccggctcacgggattccagcaccgcgctgggtgggcagttcagccaccggtgcgcgcccgacgccgagagcagcgcatgctggtcaggcatcggacagctccttcgccttggccagcagccacccgtacttcgtcgggtcaaccgccgacagcttgtccgcgccggtggcgacgatcagctcacgcacctgctcggtcatgccttggctggagagcccggcgagcactccacgcacctgcgccagcgacaccggctccggctcaggtgccggttcgggtgcctgtcggtgggcggcctcgtactcagcggcggcctgctccaggtcgggttgtgcgagcccggcggcggcgatcggacgagcgccgggcatcccggcgtgatcctcgaacccctcccacgcggtctcctcaattgcggcggcgagcatggtgacacctgccgcgtcggccagcgccatcaggtcgtcgtcggtgtcggcgacacgcacctcgacggtggaggcttcggagccgggcaggagcacggccatgcggtgctggggtcggctggtgccgaagatcgcgcgcagcatccgcctgctggggcggatttcttttgcagcgagtgcggcagccgggctgggatgcttggcgatcttgatcttgagcttggtgggcatccgggtttccttccatgtgagtggtggtacgccccatcaccgggctggtgaagggagtgccttgcatctgtcaggcatgggacgcaccgaaaccggacggcctacgactcggtgagtgttttgcgcagttgggccagaccgcgcgagacggctttccgcaccgcatcggcactggtcggctggcctgcgccggtcttgtcggcggcgatctcggtgaaccggtcgccgtggagcacatgcagctcgatgtactcgcgctgcgtcgcagtcagcggactcagcagttcgaccaccgcgaggttggcctcgacctgctcggtgaagtccggatcgtccgaggcgaagtaatccgcgcccagcccgccacgctcgtcgtcatcaccgtggccgggttggtcgacggagatgtcggagcggcggcgattgtccagctcgcggtactcggcgtacacgtcgtcgaggtaggcgcgagcccacttcggacgcgaagccgggtcgcgcagctgggcacgcagttcttcgctgtcgggcaggtcagggacgggtaggtcgatggtgttgcccctgggggtcaggtacgggacagtgaattgtctgttgaatgccacgtgagggcttcccttcttgcgaagggagaccccgttgagggcaaccgacgagagaccgtggtgttgagcggaaacagtgacgggcaccaacccgacccgggggtgaacccgggtacaggtggtgcccgtcaagcgctcaacggaggtctcccgaatacggttgaaaaacgcatgcgggtgtaggaggaaggcggccggccggtgaccggtacggctttgaccgccacagcggttgggctgtcctgccggatgacgtctggccagcaggacagccgtgagggctacttgcccttacgcggcttggcctgagccagcgccgaggctgcgaccgacttcgtcttggccgaggtgcgaccgtcgcgcagcagtgcggacgccttcttggcgaccggtcgagacgtctgcttcgtgtttcgtgtatccatgtccctgttcacctcctgcctcagctcgctccgacacggttacgcgttcatgaagatgaacgcgacaagagtgaagcggccttgtaagatcgaaggaacacaggttcgctgttcgcccttgtggttctaggttccccgatgacggttttctgatcggctgggaagcgatgggcagcgatgggtcgcgatggagaggcggtgcggtggattacaagtcgagcttccacgccgtcttggcgacggtgcgcccgctgatgaaaggcacccgtaaccttggcgagttcaccgcaggtctcatcgacatgggactcgtgcctcgcggaaccgtctacggcgagaagaccgcgcttgagatgcgcaagtcggcgacgtggaaggggtacgccaacgggtctgaccagctgcctactgtgttagcgagcgagctggctgggcgatgggatcagtttcggttcgccagcaacgtctcccaggcatacgaggagtcggcactcaatgacctagccgaccggctccacgaccttgacgagtcgatcaacaagggcaatgtcaccgaaggtctaggccagctgttctacaaggtgttcaccgaagctgccggtgagaccgctgccgtaacggagcccttgactttggcagacaaggccgaccgatctggcatcccgtacattgacgagaagacgaatcgcctcaggcttggcgaccgctcggtcgcgttaccgccgaagcatcccacaccggacacagttcagcctgctgagctggggtatgtttcggcgctcctggccgcgcattgcgaagacaaagcccgtaccggcgttgaggtgcagctggacgacatcccgtcgcgtctggttcaacacttccaagaacagcgcaaagcgttctaccgtgccgaatgggtacgagaaacatcgtggaactgcatccacgatgggcggccattgtttgacgagttcttggaaacgatgcacgcgggagtctccgacaccaacttgcgtcagtaccccaacggactcgaacgcctcctcgcgacactggctcaagcagccgcagtccaactcgacggtgtccggctcgaccagatcattgacctgatcgacgtgtggagccggaaaggttcctgccacgaactcgtcgcccggaaccggctgggatgggtagattgatgcgcgccacgtccctagacacaagtttcgaagctgaactgcgcgggctcatcttgctgttcctgctcggagatgcagcggatgccgactacctgggtgccctagacaccatcaccgtcaacgcccacaccttcggggtcggggcagagaacctcaacggcacccaccgactggccagcggggaactccacacgcgcacagtcctgatgacccaagctctccagcatttggcgatccaaggattcgtgacactacagccagatcgttctccggcggccttcacgattaccgctgagggtgaatcagtcgtcaaccatttccgctcccgatacgccggtcagttgttcgacaccgcgttggagacgatcgagcgggttggcgacctgagcacgagcgagctggctcagatcatcaggtcagcgaccccggaaggagaaacgcgatgacaccaggcttctggatcagcagcatcaccgtggccgggcaccccactcggcgggactccagcgtcggtttcgaatctggactcaacgtcatctacggaccgtctaactccggcaagtcctgggtgcttcagtgcatcgactacgtgttcgggctgaaagccgacgagttcgtcctcgacgaaaactccggctacaccgaggtgcgtatgggggtgcgcaccgcgcagggctcactcacgttatcgcgccccatcggtgagggagccaataacatcgaggtctccagcacagacccacgaattgagtctggaacctacaaacgtcaatcgtctggccgttccccgctactcagctcggtgtggctcaaactcatcggctacgacgcccctgaaaacctgaaaatcatcaagaatcaaaaccttgaaacccaggcgttgacgtggcgcaccttctggcatgcgctgtacgcggatgaagaccggatcagcaccaagaaaccaatccttctccctcttcagaccaccgcacagcccgcgttcaaatgcgccctagcgtcactgatcaccggcaaggactatgccgcctacgctcgtgatgagtctgtcgaaacgaggaaattgcgtaacaacgcgatcatcgactacctcgagccgctacccaaacagcttgaagaacgaatcgagttgatcgacaaagcactcggtagcagcgacccagcagagatccagcagcgcatcgatgagctgatcgcagaactggaacgtgtccagcaacgcatcacacacgccaccgtgcaggggcaagacgtcatcgcacgcctccaacaggtgcgtgactcgctggcggaatcccgcagtctgcggaaccgatacgaggaacttgccgcctcctaccgtgcccgcatcgagcggttcgatttcgtcgaggaaggccacgccctcaccgcacacagggaaccggcaacaacctgccccgtatgcacgcaggcactaccaccggaagcgcgatccgcagttccagagcccgatctgcgtgaacgccacgacctagctgcccgactcaacgatcttcgtcaaacgatccatcagatggatcttgaacaggcaccactgcaagaacaagagcaggatctcgccgcagaagccgagcgcatcgcccggcgcatcagcggcgagttagagccgcaactgcaagccctctcgacttcgcttgccagccacaacgcgatcatcgccatgcaggcagaaagagaacagcacctcgaacgcaaacaagccatcgaagacgaacttgaagaacgcaagaatcgcacattccccaagggcaacttcaatccgctcgacgaatacccgaaaacgttctggccgcagatgggcaccaacctgctcgacatccttggagcctgcgcgttccccagactcaaagatgcccgattctcgcgtgaactgttcgatgctgtcatcaacggcaaaaccaaagcggaggaagggcagggctaccggtcgttcgtcaacaccgctgtcatgctcgccctccgggaatacctcgcctccgaggacgccacacacaaccccggcctgctcatcatcgacaccccactactggggctcgacgatccacagctcgaccccgagcttcaagaagcccgtgaaaccatccccgctgccctctacgactacctcgccctcgaacaagacggcggtcagatgatcatcgctgacaacaccaagttcatgcccgacatagaaccactaaaggaccgatgcaaactcatcgtattcacgaaacgcgaaggagaaggacgctacggcttcctgctcgatgcccaggacgaagacctgatcgatctggaggaaacagatgacaactaaccgcgccttcagctacaagcccctctggaaactcctcatcgaccgcgacatgaacaaaatccaacttcaagaacgtgcaggcatcagtccagccaccctgtccaaactcggacgcggcggcaacgtcaccaccgacgtccttgcccgcatctgcgaagcactcgactgtgacatcgccgacatctgcgaggtcgtccccaccgacctgaagggagagaccgactagatgaccgctcaacgcctgcagctcacctggtacaacaaggacaaggctctcatccccactgagaccggcaagtacggctacacgtgggttgacccctctgatccgcgctactgcgaaacccacaccctcgtgctggacgactatgtgcaaggcagccagacaccgaagtctgacgagttcgcctactccgagcgcgctgacctggagccccaggatgacaacctgctgatcttgggtgaatcgggcgatgtcctcgaagccctcacccgcgtgcccgagcttgccgagaagtacgtcggcaaggtgaaactgatctacatcgatccgccgtttaacaccgcgcagacattcgcttcgtacgaggacaacctagagcactccatctggctgaccatgatgcgcgaccgactgcaccacatgaaaaagctgcttgccgacgacggctccatctgggttcacct

SEQ ID NO: 70 - DNA, 25150 bp, Propionibacterium acnes
ctggggccaggtatcttacgcctggccccagccacgaagcagatgacaaactcagtagatgaattcagctagagcttgacatgctgccctcttggtttcttcgctaggctcaacgcccgagtagccgtatgccccattggaaccgtctgtgagaaggccaacgtatctgtcatccaatgggccatcaatttctgcaaagaacttgtcctttgcggttcctccgtcgcttgcaccaacactctcagagatcgccttgaatcgctgcaatagcgaaactggattgttgtagtagctcctcagcgttcgggacagaaggttggggtcgtcggctcccgagcctttcagcatcgcagccagtttgatcgcatccccgtcgctacacaggtcggagtagttgcagttgttcggcagatcattggggatggtcaaaccttgaagtccgctgtgattcttatagttatccccttggccaacaagagcccttgctattgcaataatgtttgagccgggattcaggtcaacaaccttttgaatcggaccgagcgctgaagctaagtcacccgcccatcccgtccacttatcaggaacgagcgggttcaggttgatgtagcccagggtggtcacgctcatatgcgggatatctactgcaccacctgcggggtccgtccattcttgtcgatcggagcgaatccacttattcaaggcagagattatctgagacgcttgagtgtcatcttccagccttttcgcgtccgcctcccgatatgcttcagctgccgcggaccactttgcgcttcccttgaggtagaccgttgataggtagttgaggacacatcgccaagtcggaactttgacccaagtaacgtagctgccggatgtgatcggatcctctccgaaagcgtagtccttatagaccacgcgcaattcctcgaaccggctctcaagcgcttcgatcagatcgagaaaatctagagcgtcgtaattcactggctgcgcgtggcgcaccgacgaatcggctgacatgcgacccgaatatgccacgcggtcaagatcccatttcccccgatatccactgatttcgtggaactgatcaaatacccagttgtcggggatggggaaaccgagattacctgagaatccggtagacatgtcagaaacgaatgatgctaccgcgtatccagcctgagctatccgggtgcagatgtttcgcgaggcgtagatacccactcggtagccgccgccgaggctttgcgttactgccttgaagtagggcaggatgtggctggtcacctgaggatccgtggcatcgtagtcaacggcgaagtagatcactgtaggtggaacaccaagtcgttgggcagcggtttgggcctctttcgcatgacggtgcccattttcgacactaaagtacttaagttcagttgagtactcttgaaaaattgggaaatacttcagcccatgaccaacgattcgctctagctcgcctgtgcggagcgccttgaaatagtctgcctcagacttactgctttggttgggttcactgagatagcggcctacgatctgataaccatcagccttaagatgtccagcaagctcgtcagtgatctcaaagcgcgtatcgcaagccacacatggccgattggggtcgcctttagaagtgagcaggctcatccatgtggttgggtcgaccaccccggtcactggcaaggcgtgtgcttgctggaactgccacagcgtgttgctgatttcgctgttccacgtgctggtcggcaaaatggagtagccgttgcagaccagactcacagtggctagccatacccactggttagtgccgctactaattgtccgtagtttggagcgagtgcctgcaccaaaattcccggtggcttcggcaggtgtgtatccttcgattgcttggaggacctggattaaagccgtgttcatttcacgcccgtacaagccatcagtgggaatgatccctgtgtagttcttgtacccacggttaatcgcttgctgtgcctgacgaatagctgtcttgccgccgtaggcagagagtaaccggaactgtttcattgacagaagcgccatcattagttcaacatcgaccgttgcgctcgtatcgccaaggccaatatcgactttcatctggcgaatagagtcggccaagtggtcggtaaactcaagagtgatgccaccgtattcggctcgatatcccttgcaccacaaggctccttgaataatcccatgaacattgtcgtagccagaagtttgagtaatgccgtttggccaacgagacttgaatcgagactgtgttccagaaccgaaattgtttgccgtcgctgtaatacccagttcgatttgcagagcgcggatgagtgcgttgattgtatcccagccagtgttaccggtttcttggactgagccgaacccagttttattgccgtaagtcgaattcagccactgctgagttttcagcaccatttgatctgccatgattcctccttcagaaatcagttgttaactcgaggcaggcgaacacctgccacggaggggtccagaacaccggatgagaagctccgagttttttgccctcgcctgtacgtcaccgggaaacccgaatccggacggcaagagcgaaacttcgcgagtttcatccctcactggtactgccgacgaagcccgaagtgttaataccctgtttgattctgggactttgcgcgcagttggccccgcccgctgacctgtccgagcgtcgtagagatcgagaggccccaaccccctcgccagcgccgccaggttcccccgtgtctgccgatcagcaccgaggtgggcatctttgaggtttcgcaacctcggcgcgacgtggcgcgacgtggcgcagatttcagtaggtgtagatcctcggggtctgcctccaccggtcgccgtcgagcgccgactggcgggagtggcacggcttacacaaactgcggaggttggcctggtcatgggtgccgccgtgctccaacgggatgacgtggtggacttcctgcgccggggtgtaccggccagccgcgaggcagtcctcgcacaaggggtgggcggtgatgtaggcggtacgaatcttgcgccagcgggccccataacgtcggttgatcttcgggtcacgctgccacttgcggtagcgctcgtcctccgccttggcgtgggcttcgcagaagcgggcgtgggtgaggttcgggcagccgggctgggaacacggacgggcaggcttgaccggcatcacgcacccctttcccggacacggcaaagccccaaggcacccagccgatgaccgggcttgccctggggcttttcctacttttcaaccacctacatcattgcaggcccgaaaccctaaatgcatccgcagttcttgacaccttttggcggctaggttcacgcggcctgcccatacagcgccgacgccagccgggcgagcgcccgaaacttcttctggtaggcgctggtgcgctccacgtagaagtggtcacacaccgtttgcaccgcctcatcctgggtaccgtcgccgaggaagaatgcttcgagcacgaacctgtcgtcgtcggtgagcagctgccaggcgggcaggaaccacgccatgtactcacgcgcctgggcgtaacgggcacggtagatgtcgatccgatccaacgtggccgccacccgcatctccccagcatgcagatccgtgtggcggggcatcccgtcgagtttcgatgaggctggggtggtgacgtcgtcgtaggcggtcttgatctgctcgtcggtggtgtcgatgatctgctccatcacggcgaagtcctgcaatgcgctgatggctgctttgcgggtgtcgaggtatttggtcatcacatgcatgacgactccttcctgcttatggttgtgagttcggtggcgaccgcgtcgatcaatgcggcctgggtcatgtccttcgcctccagcgccttgaggacggcttggtcgagggtgccggtggcggtgaggtgggtgatggtgacaggctcggcctgtccttgtcgatacagccgggcgttggtctgctgatacagctccaagctccaggtcagcgagaaccacacgagcaggtggccaccggactgcagattcagtccgtgcccagcggaagcggggtggatcaggccaagcgggatgtcgccccggttccacgcctcgatgtccgccgacgtcttcagttcgcgggcttgtgggaagcgacgctggatgcgttcgcggtcgtgtcggtaccagtaggcgacgaggacggtttggccgttggcggcctcgatgatgtcttcgagggcatcgagtttcgccccatgcacctcgaccgtatcgccgtgctcgtcgtagatcgcacccgaggcgagctgcagcagcttgcccgacagcgcggctgcgttcgccgcatccaccacctgcccatccagatcaaccaccaggtcggccttgagctgctcatacacagctcgttctccggctccgagcaccacgggcgtggtcgtcaccgtcagatcaggcagcgtgaggtggtcggtggtgcgcattgacaacgtcatgtcggcgatagcgtcgtagatttcctcctcagcgcctgccctcggcttgtacgtgaacacctgcatcccgttgcgcttatccggcaggaaccacttgtcgcggtagcgggtgatgaatctgccgaggcgttggccgccgtcgaggagccggaattgcgcccagatgtccatgagcccgttggaggcgggggtgccggtcaggccgacccagcgcttcacgtgtgggcgcattttcaccaacgccgtgaaccgcttcgcacggtggttcttgaagctggagagttcgtcgatgacgaccatgtcgaacggccagctatcgccgtactgtctgacgagccaggggatgttttcccggttgatgacggtcaccatcgccgacttggccagcgcgtcgagccggtcagctttggtgccgaccgcgaccgccaccgatagaccttggaggtggtcccacttggctacttctgctggccaggtgtcgcgggcgacccggagtggcgcgacgacgagcacccggctgacggtgaagtagtcgagcagcagctgccagattgccgtcagggtgatgacactcttgccgagtcccatgcccaggaggatcgccgcttcgtggtggtcgaggatgaaccgcgtggcggtctgctggtagttatgcggccggtagcgcatcaagcacctccttgatgccgtccaccgagtcaacgaccagcgcggtgaagccgtgggcggccagttggctcatccggcggcgttggatcggccgaggcttcttgccgggggctttcacttcgacgaagacgacctggcctcccatcaggcatagccggtcaggtacgcccgtggttccagggcagacaagcttccagcacaagccgccggatgcctcaacggccttcttgagctgggcttcaatgtggtgttcgttcatggtcactccttgagtggtttcccacgggggtgacgactggtgacgggtggatctggacttttctaaaggagatatttttgtggccttagtaatagttcaatactgatcgtcaccggtcgtcaccctcatcgggtttagctgttgaattcgctggtcagagccagtccgtagacgtacatgccatgcttggacttgcgtcgttcaaacccggattgttcgagagtggcgttgaagtcggccatcggccgagcccacccgctggtggattgcgcccacgctcggtactcctggtacaggtcaccggcgcgttcggatagggacgggtccacctcgcagcgggcgtcgaggaattgggcgaaccagttgttctcttcccgatatgcgcttgaggcagcgaccacttgggcgggtggggtgagctggtagtcctcggcgtggatgagccgcgagccttccatgatccatgcaagtaccgctccgccggcggtctcgtagaggtggtcggcgtagttcttcacatcggagctactctcgatgaccgcgttgaacgggatcacgatgagcctgcgccagatgcccgcatccatcgcgcccaccctgggcaggtgattcgtgtagaggatgagcgtgtgggatggggtgaacgcgaacggtgccttgtatttcttctccgcgtagatctggtcggtggaggcgagttgcttgaccgtggaggtggataggcgcacgccttcctcggactctgcggcgatgatgagccgtttgcctttcgcttcggcaagctcaggtttgacgttccggttcccgccaatggtgagcacgtcggcggacatgttgcccgcatacgtgccaagcactctcgcgatagtgttccagaacgtggacttgccgttgcggccgtccccgtaggcgatcacgagggcttcgaccatgaccgtcccgatcgctgccagcccgacgatccgctgcacatacccgatcagctcccggtcggattggaagaacacgttgagcgcccggttccagatttctgcgcccgtgtcggtggggtcgagcgcggtttgtttcgtgatcagatccagcgggttatggtcacgtcgggtgccgtcacgcacatcccacgtgccgccaggcgtgttgaggagatacgggtcagcgtccagccgggctggggtggtcagcaacatcgggtgtgcttccctcaggcaggaggtgatcgcccgggactcgcggcgtttcaacacgaacgcctcgtatgccttcgcgtcctcaaatgcccggtaggcggcccgctgcggtgaggtgaaaccgccgagtgctttcgctttcgacgatgcggctgcgagcaccgcgttcgcgcccgtcaccatgagctcgtcgcgggctttctccagcagatgcccggcctcggctagttgccggtcggtcagttcctgggcgatgccttgcgcagcaggcgcagactcagaccacacaccgccttcgtagacgagccagtccgtggcctccgtaaacgccagacgcgacgagtattctgcggtgagcatggatgcctgcccgacatcggtgaagtcctccggccgcaggctcgtcagctccgcgtaggcttccggcgacagataacccggctgcgcctcgactttggcggcgaaccggcaggcgctttgccagatcgactccaactcgtgatccgacaggggcggttcacacagggacgctttccggtcgaacaggtcacgagcttgggcggtctgcccgtaacggatcaggacgcgtccggcgaagcgggagagggtggcgttgcgggagccttccccgatcacctgcgtggaagcgtcgaacgcggcgaacacgtcgatctcgtcggcctcatccagccaggcgtcgagcagctttgtgccgttgtggatggtggtttcggggttggtggtgccgtagatgaaccgtccggcatccaacgcctgcgggtcgaagaacccgaaccgtccagcgaggcggcgcttcaaccccgcataggtgtcggcgtcggtgaccgggctgattgggaagtagacgtggaagcgaggcctggccgacagcgtccttttcggcttctggtggttacggctggtggcggtcatgaactcaacccccgccatcagctcggccaggtcatctggggtgatccactcgtcggggttgtcggtgtggtcgttgtcgatatccatcacgacacagtccgaggagatgaagctcgccgaggagcgccggtcgccggtgtaggtggcggcgacgtgatccaaccacgccacctgctccagcgaggtttggtcggtgatgtggtggtggttcgggtaatggttattgtgcgggttgccgctactcgtggcggcgcacaaggtgaacggagtcatgcgggatgcacctcctggaagtcggcgtcgaagaagcggatcgggatatccatctgatgggcccagtcgatctccgcccgcatccccgggctgaccctgccgatataggcccacagctgctcgcatttcgacagcaggatgcggttgaaaaacatcgccagctcccgggcatccgggtcggtgtcatccatgaactgcggataatgcaaatgcggagccaacgggatctgacgagcctttaccgcaaacgcacaaaaccggcgggcaagctccacgttggctgctatgtcacccgagtacggggagcagatgtagaccaatgggcgttagccgtattcggcgagctggatttctttcagcgcctggtagcaggtcgggtcggggtatccgtcggcgttgcgcagcggaatacccacatcgatggtggcggtcatcaggcgccctgaccttcacgttcgatcaccggcagcaggccacgggtgttcttcaacaggtcgtagatgaacaggcgacccttctgcgtccagtacatgtgggtgcgggtcttgccctcgtcgtactcgtgcgtcttggactgcgtgtagccctgctcggcaaatttcgcgtagaggaaccagcgtccggactggtggaactgcacctgctcctcgcgcagaatctggttaagcttcttcgccgacagcccgtagtccttggcgatctctgtggcggtgatcagtgagggcgatgccagcacgatgtcgtagtacgacaccttcggtgccgcctccaacaaagcttgctcggcggcgagccgcttggcacgttcagcccggagcgtggtgatcgcccgctccagaaactcgtcgtcagcgagcagttcgtcgatggcgtagataccatgtcggcggatcgtcggcagaacctcgtcgaacacccacgtctcgaacttctgggcggcaggaagtttggaagtgacgatcagccggtacaggtcgccttcgctgatgaacctgacctgctgaaccccacctgctgtttcaagggggtagtgattcacgactcccttgcagtgacgtgccagagcgtccttcgtgttggcgtagccgagggctgtagccacgtccttgccgcagaacaggatctgcccgctagaggtgatggttcggattgtgccgaactcgtggttggtgaacacttgtagtccggtagccatgaccagctcctattctgagagccaagtagacaatcggcggcgcggggtgcgccaggctctcacctgtcaggcacggcagacaccgaaaccggacacggcttgaggaaggctctcgcccatacgcccccgagcaccgacaaatccggacgggtcagagggcacactggtgtgtgaacgtaccgataactccgtgccccgtgctcttgcttcggcgtcatcaaccaggtagccttgtagtcaacatgaccggttccgctgcccgcctcggtgggagtccagggccggtcttcgtttttcgtatcaaacaggggtgcgcgtggagcaggtgaagcagttcaagacctacggtgaacaggtcgaattgcttcgtcagcgtgggatgcgagtgaatgatccccagcatgctgagacgctgctggcgcgattgaactactaccgcttgtccggatactggtacccgatgcgccgtttctcccaaggcgacggcactgcccgagatgaattcgttgagggagcatcgtttgacctggtggtagccctctatgggtttgacgaacaattgcgccacagcgtgttcatcgagcttgatcgcgtggagttggctattcgaaccaagctcggtcacgaactgggtcgccttgacccgctgatctatttggatcccaagcgtttgagcgcccgggcacggcagcgaaacaaagacgggcgtagcgtgcacgaggtgtggctgagaaagtaccagtcggcattgaaagcgtcgaaggaggacttcgtcgcccaccacaaatccaaatatggcgggactctacccatctgggcggctgtcgaaatcatggattgggggatgctgtcgtacctgtacggcatgtcgcccaatatcgtgcgcaaacggattgccgagccctgcggcctaactggtcctcagcttgaatcatggctgaaatccttgaatattctacgtaattacgcagctcatcatgcaaggatgttcaaccgtgtttacgacatcaaaccgaaactgaacaatggcgtcaggctggctccggtagctgaaggaatgaatcgcgtgttcgggcagctctcccttatccaatacttgcaccgccaactggacttgtctccagccgaccggctaccgaagctgttccacacctacccgcacaatcccatcgtgccgttttctcgcacaggagcacctgacaactggcgcgagttgcctctctggtgcgtctaatccttgcggtagtagtcgcattcgtacccgtcggcgtcgagtggcagtcctgctgcccagtcgggtggggtcgtcatgagctggcaggcatcggcgatggtgaagccggagtcctcgggttcgtcgatgacgatttcgtcgtggacgtgcatgacaatcttgtgcccagcctgagcgacgagtgtcatggcgtggacgaggaggtcacgagcgactgcttggacgatgttctcgacgagtttcccgccgtaggtctccagccgcccccacttgcgtccggtcgtgacaccgctgtaggtgatggaggtgccgccccaccggttctcaccaagctggggcttcacgtaggccagccgcctaccagagggcagggtgatgaacaagatgccggactcggcagtgaagcgaaggttgcgcagccgaacagcctggcgggtggtgatggcgtcaagtgcggcctgctcgacatccgcccagagtcgcacgatgttggggttggctgcccgccaggcgtcgacgatgggtttgagttcgtgctcggccagccccatccgtagggcacccatcgccttgagcgctccgacggagccgttgtaaccgcaggccagcgtggcgatcttccccttctggcgcagctcagcgttgatgccgtgtttttcgacggggacgccgaacatgcgcgacgcggtctcgcagtagaggtctttgccgtcgcggaaggctgccagggtggatgtttctccggcgagccaggcgatgacgcgagcttcaatcgcggagtagtcggcgacgatgaatcggcatccggcgctggggatgaacgctgtccggatcaactggctgagcgtgtctggcacggagtcgtagagcagttcaagggcgtcgaggttgcgttgtcgggtgagggtgcgggcttggtcgaggtcgggcaggtagttacggggcaggttttggacttggacgaggcgtccggcgaatcggccggtgcgtcccgctccatagaactggataaggccgcgtgccctaccgtccgtgcctgtgacgttatgcatcgcctggtacttcttcaccgagcttttcgcgaggtcgccgcgcagctccaggacttctttgaccttgcccgtggcggactcgagggcggcttcgacatcagccttcgccaaggacgacatctcgcagccgtgggtggtgagccattccttcaactggatcggtgagttcgggttctccaacccggtcaactcccgcgcccgcgccaacgtggcggcacgatgctggtcgtccagggcgacggcagcgtctgcgagggtgtggtcgagcaggatgccggtgtcgttgatgcgttgatccagggcgtaggcgtcccactcggcttcgggaatcggaaacgatgagagccggtcgtggatcgcgagttcgacctcgacgtcgcgctggttgtagtcgatgaactgagcccagctggtcgggtcgctgctgggcaggttacgggtgccgccaccgttgagcacgctgggtgtggctggcgtgcagaattgcttgatcagccgcttacccgccgtatccttctgaacgtcaaggtcaagagccgcaccgaccgcatccaagctcatcggcagaccgagttaagccgaccacaccatcgtgcagcgccactggctcgggtcaagaaacccggccgccaacagctcggggtgatgacgctgcagccacgcggagagcgcgacccgctcgaaggcggcgttatgcgcccacttggccacgcccgggtccaccaatgctgcgagcacctcgtcgggcagcccaccaccactggcgagatcgacgacttccaccgggccgccgtcgatcgagtagccgaagatgaggaggcggaagtcggggtgttcggcatacgggtagacgccggttttcgctaggggtgctgggctgaaggtttcaatatcgatagcgatctggcgcatcagggctcctggacagtcgggtaggcgaaggtgagggagccaaccggtgtttggtggctccctcactgctggggtgctacttcgggtcgaggttgtaggtggcgttcatcctgtcgagctcggccttctccttggcgatcagctcatcgatgcgctgacgttcgcggcgtttggcccgcttgtccttaatccagtagtagccccagaccatccagaacgggatcaggacgtagacccacacggcgagggtgatggcgttgaaacagtcactcatgattcagcctccttagttgaggaagtcgtcggccggcgcgccgaagtcggactcagcggagacgcggcctgcgccaaggggttcaccgtcgcggatcttctgaatgttgcccagcccgcacgccacacccttgttcccgttcgtgttgaacgcgtagaacgacagggagacgcgggcgtagcaacccgagtacacctcggaacggtcaaggatcggagagacgttctcgtccacaacctgcggcggagtgaggctgttggcgttgacgaagaagctgtttgcgtaggcttcgtcgtcacgctcggtatccccgtcacgcagcggcagcttcagagccgccttgttggagcgcttgcctccgaacttggccgtaccagcgtcgatcgccgcgtcgatggccttctcgatagctgtgatggtggtggtgtcggccttcgggatgatcagcgacacggagtacttgggcttgccgccctggatggagttcggctcccacacgtgagcgtaggagaggcggacttcgccggtgacgacgcgggtggggttgttggttgacaaggttgttacctgctttctgttttcgtgaattcggtttgtgcgctgtggatttccagcgcgggtcgtttgtcggtgtcagacacgagcgtcggcttacccacgggcttgaccacgaggtcgccgagcacctcgttgaaggtcttcttgtccatgagccgttccatcgcagtgagcgtgatgagtctgcggtcgtagatgtcggcgtacccggcagcttcagccgcttcggcgacggcgttctcctccgtgtacttgcggacagaccgtccggcgacgagcttgaaaccatcccagtgcttgccctggttcaccgcctgcgagagcgcgtaggcctccacatccgcagcccacgttttgagctgtggaatccttgtcagcacgtccgcaatctcgctgccggacagctcggccggtggggcgaactcgtgctgggcgagcgcgaggttggcttcggcgcgtgctcggcacgtcggtgcgatgcggcagaactggcaccacgagccgggacagaactcgcccccgcccgccgcagccaactcggccttcggcttcacctcggtctcagcccatgcgaggaggtcggcgacgctggtttcccaagtgtcaacgttgccccgccggggctggtagatcgtcaccgcaacatcggtgatgtcatacaagtccccgaaagcgtggacggctccgagcgcgtacaacatgagctgcgggttgtgtgcggcctcgacgaggatgccctgcccgtacttgagatcgatgatctgcagcttgggttcggcgatgatcacgcagtcgccggtaccgaaaccgcccggcacgacgtgggagaagtcgaggcgctgctcgatcagcacctgcggatcaccacaggcctcccgtgccagtgagatgtgttcctggacgaaggcgacgtagtcgtcggtcaggtcctccatctcggtatcgatccagccggactcgggcttgaaagtcggcgcgtcgttcagggcacgccggagcttccactccgccagggcgtgtgcgacggtgccctgctcggccgccgccgacgtcgagtccggctcacgggattccagcaccgcgctgggtgggcagttcagccaccggtgcgcgcccgacgccgagagcagcgcatgctggtcaggcatcggacagctccttcgccttggccagcagccacccgtacttcgtcgggtcaaccgccgacagcttgtccgcgccggtggcgacgatcagctcacgcacctgctcggtcatgccttggctggagagcccggcgagcactccacgcacctgcgccagcgacaccggctccggctcaggtgccggttcgggtgcctgtcggtgggcggcctcgtactcagcggcggcctgctccaggtcgggttgtgcgagcccggcggcggcgatcggacgagcgccgggcatcccggcgtgatcctcgaacccctcccacgcggtctcctcaattgcggcggcgagcatggtgacacctgccgcgtcggccagcaccatcaggtcgtcgtcggtgtcggcgacacgcacctcgacggtggaggcttcggagccgggcaggagcacggccatgcggtgctggggtcggctggtgccgaagatcgcgcgcagcatccgcctgctggggcggatttcttttgcagcgagtgcggcagccgggctgggatgcttggcgatcttgatcttgagcttggtgggcatccgggtttccttccatgtgagtggtggtacgccccatcaccgggctggtgaagggagtgccttgcatctgtcaggcatgggacgcaccgaaaccggacggcctacgactcggtgagtgttttgcgcagttgggccagaccgcgcgagacggctttccgcaccgcatcggcactggtcggctggcctgcgccggtcttgtcggcggcgatctcggtgaaccggtcgccgtggagcacatgcagctcgatgtactcgcgctgcgtcgcagtcagcggactcagcagttcgaccaccgcgaggttggcctcgacctgctcggtgaagtccggatcgtccgaggcgaagtaatccgcgcccagcccgccacgctcgtcgtcatcaccgtggccgggttggtcgacggagatgtcggagcggcggcgattgtccagctcgcggtactcggcgtacacgtcgtcgaggtaggcgcgagcccacttcggacgcgaagccgggtcgcgcagctgggcacgcagttcttcgctgtcgggcaggtcagggacgggtaggtcgatggtgttgcccctgggggtcaggtacgggacagtgaattgtctgttgaatgccacgtgagggcttcccttcttgcgaagggagaccccgttgagggcaaccgacgagagaccgtggtgttgagcggaaacagtgacgggcaccaacccgacccgggggtgaacccgggtacaggtggtgcccgtcaagcgctcaacggaggtctcccgaatacggttgaaaaacgcatgcgggtgtaggaggaaggcggccggccggtgaccggtacggctttgaccgccacagcggttgggctgtcctgccggatgacgtctggccagcaggacagccgtgagggctacttgcccttacgcggcttggcctgagccagcgccgaggctgcgaccgacttcgtcttggccgaggtgcgaccgtcgcgcagcagtgcggacgccttcttggcgaccggtcgagacgtctgcttcgtgtttcgtgtatccatgtccctgttcacctcctgcctcagctcgctccgacacggttacgcgttcatgaagatgaacgcgacaagagtgaagcggccttgtaagatcgaaggaacacaggttcgctgttcgcccttgtggttctaggttccccgatgacggttttctgatcggctgggaagcgatgggcagcgatgggtcgcgatggagaggcggtgcggtggattacaagtcgagcttccacgccgtcttggcgacggtgcgcccgctgatgaaaggcacccgtaaccttggcgagttcaccgcaggtctcatcgacatgggactcgtgcctcgcggaaccgtctacggcgagaagaccgcgcttgagatgcgcaagtcggcgacgtggaaggggtacgccaacgggtctgaccagctgcctactgtgttagcgagcgagctggctgggcgatgggatcagtttcggttcgccagcaacgtctcccaggcatacgaggagtcggcactcaatgacctagccgaccggctccacgaccttgacgagtcgatcaacaagggcaatgtcaccgaaggtctaggccagctgttctacaaggtgttcaccgaagctgccggtgagaccgctgccgtaacggagcccttgactttggcagacaaggccgaccgatctggcatcccgtacattgacgagaagacgaatcgcctcaggcttggcgaccgctcggtcgcgttaccgccgaagcatcccacaccggacacagttcagcctgctgagctggggtatgtttcggcgctcctggccgcgcattgcgaagacaaagcccgtaccggcgttgaggtgcagctggacgacatcccgtcgcgtctggttcaacacttccaagaacagcgcaaagcgttctaccgtgccgaatgggtacgagaaacatcgtggaactgcatccacgatgggcggccattgtttgacgagttcttggaaacgatgcacgcgggagtctccgacaccaacttgcgtcagtaccccaacggactcgaacgcctcctcgcgacactggctcaagcagccgcagtccaactcgacggtgtccggctcgaccagatcattgacctgatcgacgtgtggagccggaaaggttcctgccacgaactcgtcgcccggaaccggctgggatgggtagattgatgcgcgccacgtccctagacacaagtttcgaagctgaactgcgcgggctcatcttgctgttcctgctcggagatgcagcggatgccgactacctgggtgccctagacaccatcaccgtcaacgcccacaccttcggggtcggggcagagaacctcaacggcacccaccgactggccagcggggaactccacacgcgcacagtcctgatgacccaagctctccagcatttggcgatccaaggattcgtgacactacagccagatcgttctccggcggccttcacgattaccgctgagggtgaatcagtcgtcaaccatttccgctcccgatacgccggtcagttgttcgacaccgcgttggagacgatcgagcgggttggcgacctgagcacgagcgagctggctcagatcatcaggtcagcgaccccggaaggagaaacgcgatgacaccaggcttctggatcagcagcatcaccgtggccgggcaccccactcggcgggactccagcgtcggtttcgaatctggactcaacgtcatctacggaccgtctaactccggcaagtcctgggtgcttcagtgcatcgactacgtgttcgggctgaaagccgacgagttcgtcctcgacgaaaactccggctacaccgaggtgcgtatgggggtgcgcaccgcgcagggctcactcacgttatcgcgccccatcggtgagggagccaataacatcgaggtctccagcacagacccacgaattgagtctggaacctacaaacgtcaatcgtctggccgttccccgctactcagctcggtgtggctcaaactcatcggctacgacgcccctgaaaacctgaaaatcatcaagaatcaaaaccttgaaacccaggcgttgacgtggcgcaccttctggcatgcgctgtacgcggatgaagaccggatcagcaccaagaaaccaatccttctccctcttcagaccaccgcacagcccgcgttcaaatgcgccctagcgtcactgatcaccggcaaggactatgccgcctacgctcgtgatgagtctgtcgaaacgaggaaattgcgtaacaacgcgatcatcgactacctcgagccgctacccaaacagcttgaagaacgaatcgagttgatcgacaaagcactcggtagcagcgacccagcagagatccagcagcgcatcgatgagctgatcgcagaactggaacgtgtccagcaacgcatcacacacgccaccgtgcaggggcaagacgtcatcgcacgcctccaacaggtgcgtgactcgctggcggaatcccgcagtctgcggaaccgatacgaggaacttgccgcctcctaccgtgcccgcatcgagcggttcgatttcgtcgaggaaggccacgccctcaccgcacacagggaaccggcaacaacctgccccgtatgcacgcaggcactaccaccggaagcgcgatccgcagttccagagcccgatctgcgtgaacgccacgacctagctgcccgactcaacgatcttcgtcaaacgatccatcagatggatcttgaacaggcaccactgcaagaacaagagcaggatctcgccgcagaagccgagcgcatcgcccggcgcatcagcggcgagttagagccgcaactgcaagccctctcgacttcgcttgccagccacaacgcgatcatcgccatgcaggcagaaagagaacagcacctcgaacgcaaacaagccatcgaagacgaacttgaagaacgcaagaatcgcacattccccaagggcaacttcaatccgctcgacgaatacccgaaaacgttctggccgcagatgggcaccaacctgctcgacatccttggagcctgcgcgttccccagactcaaagatgcccgattctcgcgtgaactgttcgatgctgtcatcaacggcaaaaccaaagcggaggaagggcagggctaccggtcgttcgtcaacaccgctgtcatgctcgccctccgggaatacctcgcctccgaggacgccacacacaaccccggcctgctcatcatcgacaccccactactggggctcgacgatccacagctcgaccccgagcttcaagaagcccgtgaaaccatccccgctgccctctacgactacctcgccctcgaacaagacggcggtcagatgatcatcgctgacaacaccaagttcatgcccgacatagaaccactaaaggaccgatgcaaactcatcgtattcacgaaacgcgaaggagaaggacgctacggcttcctgctcgatgcccaggacgaagacctgatcgatctggaggaaacagatgacaactaaccgcgccttcagctacaagcccctctggaaactcctcatcgaccgcgacatgaacaaaatccaacttcaagaacgtgcaggcatcagtccagccaccctgtccaaactcggacgcggcggcaacgtcaccaccgacgtccttgcccgcatctgcgaagcactcgactgtgacatcgccgacatctgcgaggtcgtccccaccgacctgaagggagagaccgactagatgaccgctcaacgcctgcagctcacctggtacaacaaggacaaggctctcatccccactgagaccggcaagtacggctacacgtgggttgacccctctgatccgcgctactgcgaaacccacaccctcgtgctggacgactatgtgcaaggcagccagacaccgaagtctgacgagttcgcctactccgagcgcgctgacctggagccccaggatgacaacctgctgatcttgggtgaatcgggcgatgtcctcgaagccctcacccgcgtgcccgagcttgccgagaagtacgtcggcaaggtgaaactgatctacatcgatccgccgtttaacaccgcgcagacattcgcttcgtacgaggacaacctagagcactccatctggctgaccatgatgcgcgaccgactgcaccacatgaagaagctgcttgccgacgacggctccatctgggttcaccttgactacgcggagaaccaccgtatgcgactgctgctggatgaggtcttcggttgctcaaacttcattgccgagttcgtgtggcagaaagcagactcgccgcgaggtgacgctcaacgtgtttcggtggatcaagatgtgatcctttgctatgccgcgagtggaagcacagtcatgaatcgtatggaaaggactgccgcagataacgcccgcttcagtaatcctgacggcgactctaaaggtgtttggttcagtgataaccgctccgcgcccacaaacgttatgtcttggcagcaccctagcacctttgcaattcagcacccaatcagtggcgagatgatctacccggccaagggtggatgctggcgttttggtagagaacgtctccttgagtcattgaacgagtacgcggagtatgcaagcggtgatgtagacattgcggctcgggttgcaaacacatcgcttcggtcagatcaggttcgttcagacattcctgacctggtattggtcgaccccgcttcagcggctcaatgtgctcacacaagaattgatgatggaaattggccagaattcttcgtgactgcaaccagcttcggcagaaagtcctatcctcctaatgaaggtcagcctgcccgttcatggtggcctaatgatcaggtgggacacaatcgcgaagctaagtcagaaataaaggctctcttttccggtgcgacgcctttctctacccccaagcctgaacgtctcctcgaacgcatcattcatatcgggtcgaacccgggcgacattgtgctggatgtgttcgctgggtcggggacgacggcagccgtcgcgcagaagatggggcggcgttgggtgacgtgcgaattgctggagtcgacgttcacaacgtttacgcgtccccgtctggagaaggtgctcaacgatcaagacccgggcgggatcactcggactaagggcaaacgagtcgacgctacggaagacgggctgcctgatggtgtctcgccggaggacgccgcgaaattcacgagcgtgctcaacaagctgatcaaggacgacccggaattgaagaaaagcatcgaggtgaagacactgaaggctgcctcgaagaccagacgcacgaaggaagtagtgaactggcgtggtggcggcggcttccaggtcgcccatctgtcgcctgcgtgtttcgactacgcccctgaactggaccgggtgatgctaactgcggccgcgaccggacagactctgatcgagtcggtgactgccaacctcgggttcacactgttgcacccggatgatgactatatttttgatgcccgccgtggcaatgccttgttgaaggtggtggagggtgtggccacgaccgagatcgttgactggcttgcttcccaaatccagcccggcgagacaatcgtgctggccgccaccacggtgatggacggcgtgcgccagcatctgcgcaaactggtgaaggggtcgcgggtggtcgcattgcccgatgatgtgtttcggtacagcgaaggtggtgaccagtgatggcgaacaggctcaacatcagttttgactccgacatgctggagtcgatcagtgccgagttcgacctgcgtgctccgaacaaggaagcactgcgccagctggtcttcactctcgacggtgactatgacccgaccgtgatgcaggtgctcaacctcgctacgggcgtgggcaagacctacttgatggcggcgtttgtggagtatctgcgccgccaaggtgttggcaacgtggtgattgtgacgcctggtaagacggtgcaggccaagacggtgcagaacttcacgcctggttcgtcgcgctacattactggttcggcgcttccgccggaggtggtgactccgcaggattattcggcgtggatcgcgcgtcaaaacggcccggtgcaactcgcgttcgggcgagagactccgatgttggcattcattttcaatattcagcagttgattgcccctaagtctgatgagggtgacactttgggtggtacgcaggatgcgatgcggcgtaagcctcgccgtttcgatgagaacgccggggtgcttttcgattatttgaagggtcttgatgatctggtcgtgatcgctgacgagtcccacctgtacgggtcgagtgcggtggcgttcaatgcggctttaagagaactggatccggcggcggcgattgggcttactgcttcggtggataagaaaaccgatcacgtgatctatgagtatccgctgtatcgggcgatccaggacaaatacgtcaaagccccggtgttggctttccgtaagagtgggtatggcacggacgaggcctctgaggaacagcagttgcgggatgctttgcagctgcgggcgatcaaacaagcccactatgatgcttatgccgccagtgaaaaccgtgctcacgttaacgccgtggtgttcgtcgtgtgttcggacgtggaacacgctacccaagtagcggagcttttgcgtaccccggaatatctcgggcgtgacgaggcagtgttgcaggtggactccaaacatgaggacgagctgacgcagcgccgcttgaacgagctggacctgcccggctcgcccgtgttggcggtggtgagcgtgaacaagctcaaggaaggctgggatgtcaagaacatcgcggtcgtcgtgacgttgcgggcgatggcttctgaggtgctcactcagcagacgatggggcgcgggctgcggctgccgttcggccggtatacgggtgtgtggcagatcgaccagctcgacatcatcgcccaccaatccttcaccgagctgctcaacgccgagaacgtgctgcagcagttcggcctggacgaagccatcgccgagcccgacaaagccaaggtagaagaggcgatccgtaaagccgccgaagagtccggcacgggtacaggtacgcccacgaccggcggtgaccaaccaacgacgacaaccggttctgaaccgggcaccggtgtcagtggtgaggtcgccggtggtgtggctccgcagccgggcaccgttcccgtcggcggcagtgattccccgggtgcgggtttgcccggtatcggggttcgcaccatcaccgaacaggaggatcagcccacctgggagttggtttcgatcggacggaacccgagctttgctgacgtgtcctaccgattcccggtgacgacgatgactgtgcagcagccgcccattgacctgtcagaaatcagtgacgccgagattgagcaagcggcgcgtcgggtcacctctgctggggacgtgctgctgcgcaaagagatcatcgccgccctaggcaagaaactccgggcagaggatcgagaaagcgccgaagtcgactccgtccacgtcgacgacgccgacgccgaggaggcgctggtcaaactagtgatcaacatgtcgctggtgcccaaaaccgaacagaccgcccgctacgtcgccacgttcctggtgccgaagttcatgcgcaccgtgacgttcaccggctggaccgtcaaatccctcgactccgcccgcgccgaactcctagcgctgatcaagaactacacaaccgagacactgcgagccacccgcgaggtgccgaccatacaccccaagtcgatgccaggcaccggctacacgctcccgttgggtgagaaggtgcatgaccagatcgagagtcgtgaccagttcgtgcgaggccgggtctacggcggctggttcaagtcgctattcgccgaggagtccttcgactccttcaccggcgaataccagcttgctcgcctgctcaacacgtcgccggggatcgtgtggtggcatcgcctgcatccgcaagaccaggcattcgtgtactacaacgcgaaagaccgctacttccccgacttcgtagccttggacaccaacggggtgcattggatcatcgaaggcaaggacgagcgcggccgcgatgacgccagggtgcaggccaagcgtaaggctgccgaggcgttggtgcgccggttggtggctgaggatgcctacgccggtcagcactggggctatctgatcgcctacgagcaagacaccgcccgtgccgactcgtgggaagacctgaaagccttcgccagcccggtcagcaacgccctgtagctgcgagttcgcctgggcgcatcacggggctccagcgttgcgggaggtcgagggtgacggcctcgccggtgatgaacacgaatccgagcctgccatcggtgagcatgcagccgccctccagcatggcaaggaagtccgggatgtggagcgcaagctgggtcggcgattcggtcaggagcttgtcgatcgccgtgtggagcgtcgatgggcgtcgccgcgcacccgttgactgcaggctgtccacggcctggtcaaccgccgtgctgttgcgcccagcgagcacctgcaacgcctcggccatcttcaccagcagcacctcctggtagaggtggctggtggtgcaggtgccgcgcttgacgtagttcgtggggcactcccacacgtcgacccggttcggggtaccggagtgccaggtcttgtggccgaacggccgtccgcagtcgccgcagacgatcttgcgggacaggcgcttgccgaaggacttgtagccgcgtgggtcgacgcgggtgcccagccacggcaactcgcggtctgcaatgccgagagcctcggcggcgtggcgttgggcgtggaatgcgtccatccactcgacggtgtacccggcggcgagattttcgaggaggaagctggtcagccggtaggtcagtcgggcttgtactgttgcgagttcggggtattgcatggtgggggctcctgtctttgcgtcacgtacatacacgctctgatcagggctaatagcaagtcgtaaacggcgataccttttagcgcttgccgaactatttggcgctccgttgtcagcctcgacgcacgtggttcacgccgccccacagcgcctctcggacaagccagccaccggagccgatccgtccgaatatgcggctcgacggtcaacactaaggcgcgttttacctagtggggagcgggtttcgccccatctgcgtcatccgcgcaccacaaacccctgtatccacttcgatacagtctgc

SEQ ID NO: 71 - DNA, 7797 bp, Propionibacterium acnes
ggtggtgccgaagaagaaggaatggccccaccaatctgctggtcggtagaagtacggggtttgagccagtcgagtagtttcataatctgctccttgcaaggtattgtgaaggatatgaaatctcttacccctcatttgcttctctgctcttttttcacaagcattgctcctgccttaggagaaggatttcgcaacaaacgtgtggctttcattccgacagcagcagcccacgaggagtacacagcctacgtggattcagcacgctcatcatggaaagaacttggcagcaatatcaccgatgtggatattgccagaatgcctctaagaacagcgaccgaggcgcttgagcaagccgagataatctatctttcaggagggaactccttctacctcctcgattgcctacgctcaacagaaatcgaccagattattcgagggcgtctggccgaaggggcgattctagttggtgaatcagctggagctatagtttgtagcccaaatatcgcctacattcagccaatggatcgtgtccctgacaactacagccaggctgactacaccggactgaacttagtggacttcttcccggtacctcactacctcgcccctccatttgtgaagagttccaaggaagtagtcgcccagcacgctagcctcccactcgagctcatgaacaacgcagaagcggtaatagtagagggtccccaaaggacaaagatctcatcagagcaccagtagtcctcgtgagtcgtacaccgacgtgcccgtgtggctgccaccgcctcggatagcgcggtcgagggccatgatggtggcgaccacctcgtcgatcttctcggtggacttttgcttgtcgggtttgatgtttcctgccgggtcggtgcggacgtgaatgttgtcgaccatccaggacagcactgggtgcctgccgtgagcgagcctaccttctagtgcgagtctcatgagctccttggacggtgggctcatgtctttgaagccttgcccgaagggcacgacggtgaacccggcatcgtcaaggttttggctcatctggactgcgccccacctgtcgaaggcgatctcgcggatatcgaagcgtgtcccgagttgctcgatgtggcgttcgacgtgggcgtattggacgacgttgccctccgtggtctctaataagccctgttggtgccacaggtcgtagggcacatgataacgcgccacccgcaacgccaggttgtcctccggtatccagaaccacggggcgatccggtacttcttcgtccccgtagggtgggaagatgaggacgaaggcggtaatatccgtcgtagaggcaagatccagcccgccgtagcagcgtcttccttccagctcgtccaggtttaccgggtcggctcccgcgtcccagatgtgcatgggcatccaccgcaccgactgcttgacccactggttcaacctgagctgccggaacgtgttctcctcggcagggttctgccgggccgagttgcacgccgcgcgcaccttgtcgatcggcaccgtcacgcccagtgaggggttggctttgcgccacacggcctcatcggtccaatcatcatccgcgtcggccccgtagatcaccgcatagaacgtcggatcatacttcttgcccgcgaggatgtcctggactttctggtgctgctcatagcaaatcgaatgcgtatcagttccggcggtggtgatcaggaaatacagcggctaggtgcgtgcgtcgcccgaacccttggtcatgacgtcgaacagggctcggttgggttgggtgtgaagctcgtcgaagaccacgccggagatgtcgaacccgtgcttgaagtaggcctctgcggagaggacttggtagaaggagttggtgggcttgtagatgattcgcttctgcgaagagaggatcttcacccgcttcgacagggctggtgattggcgcaccatatcggcggcgacttcgaacacgatcgaggcctgccgccggtcggccgcacacccgtagacttcggcacgctcctcaccatccccacacgtcagcagcagggcgacggcggcggcaagctctgatttgccctgcttcttggggatctcgacataggcggtagtgaactggcggtagccgtcggctttgacggtgccgaacaggtcacggatgatttgttcctgccagtcgatgagctggaagggctgtcctgaccagcggcccttggtgtgtttcaaggcttggatgaacgcgaccgcgaagtcggctttccgcttgtcataggtggagcctgcggccatgaaccgggtcggcgtgtaggtgtcgagagtgcgcatcacgcccgtcaggctccttcctgtgctggttagttggtgtgggcgaaggcccaggcgatggcgtggccggcgtcagcgaacagttcgtcagcctcggcgaccaggtcgagttcgcattcactgaagcctcgggcgtcctgtccccagccggagatcggctgctcggcgagcttgtagacgcgggcgtcgtttccgatccggcctttgcccaagtgccggtaggccgaggcgaggacgaagtccccgtaggcgatcaccgtgccgtagctgtcggtcgccatctgcagctgctccatcgtggtcttttcgttgttcatgaccttctccttcttgccttgttcggtcatgtacatacagccataggtgcgcgctcttatccagtcgtaaaagccctagtcagcccactatttttgaggaatctttgaggggcgacgggcacggaaacggcccctgattgggtgggtacccacggtggcttggggtcagtcgatggccaggtgccaggcggggatcatgcggcgttccccggtgatcgggtctgggtagcggtcgttgacttgggtcatgcctcgcagggttgcccctgcctgggtgaggttccagatgatcgtggtcaggccggtctggttcgcgctgatcgtgaactcgccgatgctgtgctccttgagttcgtcgaggatgctgggcacgtctgagtcgtagagaccttcggcgaagtcgagcagctcgttgcccgcccgctggctgttcatgtagacggtgagcaggctcgtggacgaggtttgggtgcgggtcgcgatcttgctggtcgaggtcgtcaattgtgttcatcgcgggtgtccttgtgggtgggtggggtgcgccaggcggcgttgccgtccaagtgtttgagcaaggtgcggcggacgggtttggtgtcgtcgccgatcagaccgaggcgcagcagccagcagcgcatcgcatatttgtcgttcccgcccgtttcggcaggtttggctgaggctcttgtggcggttttggcgtggtcgatgatccgggcgatcagcaccgtggtggcctccactacctgcgggtcgggcgctacgtcgaaccaggggaactcgaccgtcccggcctcggcgtcgatgctcatcggggttgcggggatctggagtgctttggcgatgagctctcctttcgctgctagcgtcgcctccaccttccctttcgtggtgtcctcccaaccggtggtggggaacgccaacgtcaaccccaactcgcctggctcgtcggtggtgtccgtcgggaatccggcctgcgcggccgcctcgaccagcccggccacgtcggtgtcctcgggcagatgcagcagccagtcacgatccaacatggcctcgccaatctggtaggcaaacgttggggttcccagatactcgacggtcgctcgcagctgggtggcgagaaaagcggcgagttgcttgcggcctttgcgctgcttggtgaacttgagtgtcgtcatgaccggcctcctttgcgtgttcccctggtcggagtggttttcggtcatgtacatacacgctctatcccgaccagatagcaagtccggacggccacctatttcttgcctcgatccacggccttcaccacatccaggtaggccaactgttggccgtcgcgcaggcaggtgatacctgcggcgtccccggtggcgtcggcgtagcggcgcagaatgactgaggcgtatttctcgtcgagctccatgcagtaagcgatccggttggtggcctcacacgccatgagcgtggagccagagccggcgaacgtgtcgagcacgatcgcattcgcctgggtggagtttccaatcggatacgccaacagatccagcggcttcgaggtcggatgatcagcattcctgcgaggcttatcaaaccgccagacggtggtttgtttccgatccgcgtaccacgtgtgcttgcccgtcttcacccagccgtagagaacgggctcgtgttgccactgatacggggaacgacccagcaccagggagtccttgacccagatgcaacaccccgacagcttgaagcccgcgtcttgaaaggcgcgccggaagttcagaccttcggtatcggcgtggaacacgtacgcggacgcgcccttctcacacacgcccgccatctgagtgaacgctgcgagcaggaactcgtagaacgcgtccgcgctcatcttgtcgttcttgatcgacaagccgtcagacgattcgaaggcgacgttgtatggcgggtccgtgagcaccaagttggccttcttgccatccatcaacagctcgatgtcgcccgcgttggtggcgtcgccgcacaccagccgatgcctacccaccgtccagatatcaccccgctcgacgaacgcggcagcctccagggcggcggtcagatcgaagtcgtcatcctccacctcgtcctcatccaaggagccgatgagctgggcaatctcatcgtcgtcgaacccagtcagctcagcgtcgaaatcactcgcgtccaggtcggcgatgagcagggcgagcttgtcctggtcccagtcgccactgatcttgttgagcgcgacgttcaaggctttttcgcgggtctcgtccaactcgacgaccacgcagtcgacagtggtttcaccgaggtcttcgaggactttgaggcgctggtggccgccgacgacatggccggtggtcttgttccagatgacaggttcgacgtatccgaactccgtcagcgaccgcttgagcttttcgtagtcggggtcgccgggccggaggtctttgcgcgggttgtagtcggctggcgtgaggtcagcgatgggtagctgctcgatgcgcacggggctccaccgccttccgcaggtcgcgctcaaaacgccaggtttgttcccagcgcggccaatcccggcccatgtgcccgtagaccgcgagatcccggtaacggggtgtgcgcaggttgaggacgtcgatgatccccgccggccgcagcacgaacacgtcacgtgcggcggcggtcaagatgtggtcggcgtactcgccggtgccgagcgtgtccacctcgaacgcgaccggatcagccttcccaatcgcatacgagatgcccacctcgcactcagcggccagcccggcgtcaacgatcgtacgagcgatcaggcgagccatgtaggccgctgaccggtcgaccttggatgggtccttgccggagaacgcgcccccaccatgagacccgagcccgccgtaggtgccgaccatgagcttccggcccgtcagcccggtatcggctcgcggcccgccctcaacgaaccgacccgacggattcacaagaatttcggtgtgctcgtctatgggtaggtaggtctggcaggccggggccacaatcagcgagcgcacctcacgctccaacacggccagatccttgcccgcctcatgctgcaccgagaccacgacggtctcgacggcggcgggggcaccggtgtcgtcataacgcacactcacctgggccttgccgtccgacttgatcccgcagatcgtcccctcgacctgggcagtatcgagacgctcgcagatgcgatgtgccaggacgagcgggagcgggaggcgttcaggggtctcggcggtggcgtaaccgtagaccgtgccctgatcgccagccccctgcaacgcgaacgccgaactatcaccaccgcgtgcctccagcgaggtggtgaccccggcgttgatgtcgctcgattggcggcgcgtccacacgtagatcaggatcccgagcggactgtatccggcacgcgcgagggcggtgcgcacagactcccggatacgcgggcggtggttggtggtgatttcgccggtgacgatgatccgccgaccggctgccatcacctccaccgccacccgtgcggccttgtcgtcgtagaggatgtcgtcgaggatctggtcggcgatctgatcggccaacttgtccggatgaccagcacacacagactcggcagtacgaatcgaacacataagcacactcgcttccacgaatcggaggggaacaagaaagcgtccaccccactagagggtggacgcgaagatcatgaggggcggttaggagcgggcgttgagcagctgctccatcacctcgtcgccgggcgtggtgcccgcgtagtcggtggtgcaggtggcgcgcacgatctcgtaaatctcgtaccaatacacattcgcctgcttcccgaaactctgggacatggcgacaaacgggctggcgatggcggcaccggtggtggggtgcttgccgagcaggccgaacttggagatcgcctgctcgcactgcacataccgggcaaacgcctgcgcatacgcctcaatcaggcgaggcgccacgaattgggaaccgccacgttgatcgagccactgccacgtctcccgatagacgaggtcagcgccaagcggtttgccgtcacgctgaatctccgacagatagtccgatggttcgggcatcgtctccccggcaagcaccgcaccgtcgccaatgtcattacctgcgaagtcgaagggttcgttgagcgggtcttccaggcgggtggcggggcgtccggcggcgagtttctcgcccagcgggccgggcttcgcgcctgcacgcacgcggcgtccgcccctgttggtgccgtctttggccatgggtcgcctccccgccgtagaatcgtcatggtttcggtgctgaagtccacgggaggtgtgagtggttgagtctttaaaactattcgttcggacctacgtgtattgggtagggctcatccttggcttcgcgatagtgcccggttctctgctcttcactgctgaagtcgccccggtgaacactccattgtggcttgcacctttcgccgggctgctgctttttgtcattgatcggccatcaacatgggagccgccgctctggcgagcattactgatccgagtattgggtgcaggatttgcagccaccatgctcatcgcgtttgatgcagttgcttccacccactatggatctcaacactggagtgagacgctcctatctttcggtctcggttggattgtcttcacggtagtggcaggacacatgctcatgagcagctccgcccgatttggcacacctgctcacacgatcagggacgcgatccgtacctacacgacatggataggaatctgcttcgggattttctatatccccgccgcgggactctccgcagctggcactcttttgatggttcttccgctttatggaacgttcctcgccggcctggttcttttgatagttgacccgccacgacgatggccgcaaccgcgagtgaaggcactgtggatacgactcttgtcaagcgtggcagcagcattactacttgttgtcacgaactcgttctatcgcagtactcgcacacacgagattttcgtcggggactggcaggaaaacctggtcttcttcgtgggtgcttgggcactttatgccgca

SEQ ID NO: 72 - DNA, 18956 bp, Propionibacterium acnes
catcatgccgacgtcaaggatcggcgcggccatccaccgggggacacgctgaggctcgggtgatgagggtcgtaggaatctcgactgttccactgggatccgttccaagggcaagacgggccgcagtttctcccacggcggcgaaatcaagccgcaccgtcgtgagcgctggccgagtggccaccgaatggggatgatcatccatgccgacgaccgagacatcctcgggaactctcaaccccaacctgtcaagccctgttaagaggccgagagccacatcgtcgtttccacataggactgcggtcacctggtgcgctcgtaccgcccgtgcaacgtgcatacccgtctcgactgaccacccagtcgccaatggttcgagcggcgggagacctcgagtagccaggacttcgcgccatcccgcacatcgtggatcagggtgccctgcaggaggaactccgacataggcgatgcggcggtggcccaaacccgccaagtattcggtggccattactgcaccggcatgatcatcgatccacgcccgagaccagggctcgcctccctcgggtttgcctccggcaatggcaactgggagatcgacgggcaacccaggcaggagggccacgctgggggaatcaaattcaaggacgacaaccccgtcggcacgagcgtctaaggcacattgcacggtggaacggcatcgctccggcgaccccgccaatacatgtagggaggtctcggcaccgaggtcgagggctgcgctgagtacccccgagagcgtcgcccagtagccggtgcggccgatgtcggagacgagaacgtgcagccgggcgacgtcagggtcggtgcgccaatatcccagctcggtggccgcggtgaggatctcctcggtggcctgcgggagggcaccttcagcgccattctgacgtgccaaggcacgcgacgccgttgccaacgagacgccggagcgctcggcgacgtcagccaaccgcggaggccaccagggccgcctcaccatggccgggtcacgttccatgcaccggacgataccgggttcacacccctgtcctcggcaagggcgtccgcggaagaccagggcgcgacggggccgcatccgcggctgctgaggtggagcgagccggggtggacggaacgggaatcgacgtcgccgatgggccgggaagaggcgaggggatcgtcgtggtgagcgtccagaccgctgccgtggccaaatccgagccctcgaccacccggctgtcagctacgacgatcggcaggccggtgaactttgagtgcagggtacgccccgccccgtttgcaagcaggtgccagcggttgaggctgccctcagtatccgacgtcgtccgacgaccggacccgacgacgacctcgtgcttcccaacctcggcgtcgagaccaaggaccgcgccgccaggagtcgaaaggctgtaagtgcaatcgtcgtgccgaaccacacaccaagtctgaggctgcgcctgcagggtagggacaccgtcgtgaaatgccaagaatcgcccgtccgcgctagtcagccggtagtcgccgggctccagtgccgggttgggggcgtaccaagcgcgcacgtagtcgatgtcaaaactcgccgggagtcgatggacgactggggcccccaggtgtccctcaagactgagcaccatatgccgcgacatccgccacagcgaagggtcgccgggttttgtttcccaggccaggtgtcggtcgaaataaaatcggagttgaccgtcgcggcgttcgacgccatacgtgtggtagtcccgcgaaatgtcgacgccaaccgggtaggcgtggcctccgaagcgccggtgcgtgacctctgtgttatcgggccacacgtgggtcgcgatgttcatcttcgtgtagtcaaaagtctcctcgacgtcaagctccgggtttggctcggcgccggtaagcaaggaagggccaccgtcgagggcggacgactgcatccagatggccgacagcacccgggcggccgagggcaacgccttggcacgcacctcgacgtaggtgcacagacccggcacgtcaaagactgactcaacggcgccaaacgtgtaggaaaaactatcgacctgctcggcacgagcagccaaatggagttgcccgcctgagaaagacacattcgcgtctcgaaagaggccacttcccgagtgtgggtaccacaggccgcgatgccactgggccgagctgtgagtcggatcggtgaattcgtctccaacacccaggagggtccagccagcaaggtcgatatcggcatcggcggcgatagcccgatcgtggtcggcaaccaccggaacggccgccgtgagaacggcagctccgaggactgatctacgtgtgatcagtgtcatgtgtgctcctttgcaacaacgtcactccctaactggggttccatgcagcctacgacgaatgactgcggtcaccacgagcgcgtgaaaacggcctttcatgcgctgtggacggcccctttcccggcacctagggtgaacgacatcacgaacgacggccaatgtcggccagccaggagttcaccaccatgcacgatgtcacccctgtcatccagccgtttcggctcgcgacggcccccgaccaaccggtcggcttggcagccgggactcttgacggcgcggtggcgcttcccctcgtcgaatgcctcaccctcgaacacggccgatgcttcgtcgaccatcgcctcacccaaactacggtgggatccggtctgcgtcccgttcgccgcgaaccgctcacctcgccgtggcccggcacccgcgtcatccagcatgatcgaggatccgacctcaccgtcaccgtcgatctgtggcatcccacctcagcgacaccttgcacgggcgaacaaccgtacataatgacggcaagctcccagtccatctcactgccgtctctatcatgtgcgccagtctgctgtcaggagccgaactcgatgacctcgatatactcatcgcacccagcgcatggatggccgaacaacggtggacccatcaccgcctgtccgatcttctggtggacgtcggcaccgaattgcatggagaatccccgcgcgaccgcttcgtcctatcctcagagtccggttggtcttcaggacgttgggaaccggtcggcttcattaccgacccggcctctggacgcgccgtcggctggcagatcgagcacaacggtggctggactgtcgaattagcccggcgctcttcaaccctcggcctctgcctcttcgggccgaccgaccttcagcaccactggatgcaccagctcaaccctggcgagactttcactacccccgcggtgacgttagtggtatccgataacagctggcagggcgcggcagccgaactaagcacctaccgccgtgtattgaggggcaacaatggcacagcagctccgatcgtcttcaacgactacatgaacaccctcatggccgaccctacggccgagcgactctcgaccctcatcccggccgcagctcgcaccggagccgaggtgtactgcatcgacgccggatggcactccgacgacacagactggtgggacgacgtcggccgctgggagccctcgccccgccgatttcccggcgggctgcgccacacccttgatctcatcgtcgcctacggcatgacgcccggcctgtggattgagccgctggcggttggtctgcgcagtcctctcgtcaatgatctacccccggaggctttcatgcgccgcgcaggggttccgatcgtcgaacagaatcgggtgcgtctagatatgcgcaatccgcaagctcgcgctcatctagataccgtcatcgaccggatggtcagttacggcatcggctacctcaaaattgatgacaatttctctgtcggttctggccccgacgaggacgcggattctcctggggacggtttgctggggcactgccgcgcttgggccgcctggcttgccgacctccctcgacgtcaccctggacttgtcgttgagaactgtgcatctgggggcatgaccaccgactacgccctgttggcccgagcagccatccagtcgacatcagacctccaggattcggtgcgttacccgcccatcgccgccaattcaccgatgacgattttgcccgaacaagccgccaattgggcttacccacagccagacatggacgacgaggaaatcgtctttaccgtcacgacctccttggccggcaccttttacttgtccggtcatgtcgaccgcatgaacgcccaccagatggctctcgtgcaatccggcgcagaggtagccaaggccttacggtcagatctgaccagccaaataccgtggtggccgaaaggccttgccggctgggacgacgagtgggtcgtcaccgggcgtcgaaaaaagtcctctcgcgacggggtgatcattgtctggcaccgtcctagcaccgaatcgacggttctcgacttacctgacctggctgggacccacctcgaacccctttacccacctgcctccctggtccccgacccaggaattcacattgctgactcatcgggttcacctcggctgagttgtccgtctcccaaaccaaccggccgggtcttccgcgtccgggaccttcacgattgcgtcaccgatgtcgcagaaatggagaagaaatgaatcgcaccctcaaggtcgccgcagtaggagccatcgcgatattgtgcctcgctgcctgctccgacccaggctcagactcggcgcaatcctcaggaccggagtcatggccgtcagcaaccaccaatctcaacggtgtggagttgacaatgtgggccgcccagtcgtcggcgtcgatccctcaacaggtcgccgtggacttcaacaaggctaccggggccaagatcaagatcgtcacgatccccgacccctacgagcagagcgtccagaccaaagtcgccaccggtgacgtccctgacctggccatgtggcagccaacgacgtcaatgctcacgagcctgggagccaaagagcatctgcaggtgctcgacgatgccccgtgggagtcgaagactgacaagaacgtcctggctgccggtggttctctcgacgggcaccgctacgccgccttcgtctcagccccctcggtcatgggcgtttggtacaacaaagaagttttcgccaagaacggcatccaggtgccgaagaatttcgacgagatgctcaccattgccaagaagctcaaggctgccggccagaccccgttctacgagatgggcggagagtggtgggcctcccagtgggcggtccaggtgcaggtggccgacgccgccaaggccggtctgtgggacaaggtcaacaagaacgaggacaagttcaccggcactgagatccaaggtgctatcaacacctacgacaccatgatcaaggaaggtctgttcaattcggacatcacaaccggaactttcaacgaccaagccaaggcgctgcttgacgggaaagcagcgatggccattcaagtaacgagcctattgggcaacatggccgcccgagccgacaccgccactctcgacaagaagatcgggttcttccccatctctaagtcgggcaccgtggcaacgtcgatccccgaccagaccaacgccgtggtcgccttcaaatcgaaggatgccaagaaggagactgcgacacgtcagttcatcacctactggttgtccaacgactacgcgtccttcgtcaaggtacaaaacaccgtttccatcattaacggtgttaaaacgcccgattccgtgcccaaagccctcatcgactcgaacgccaccctcaaaggttcggtcggctcgatgcagtctctggctgtcgccaaccccgacttagctaagaacctcggtgacatgatcgctggcacgaagactccagcacaggtgggctcagagactcagtctcagttcgcccagctcgccaaggcgattggcgcgaaagggttctgatccatatgtcctcgatggaagccgcaccgcgacacggcagtgcaaaccagtcgcatccctggggattcgttgtacccgcgttcgccgtgctcgcggtgttcttcctcacgccaacgatctacaacttcatctacgccttcaccgactggtcgagcttcaaaacggccatcaatccggtgggatggagcaatttctccgatctcatcgcatcaggaagcctgcggaaatccttgactatcacccttatttacgcggctggcgtggccacgctgcagaatctgttcggactgatgctggccgtactgttggagcgcgacaccctcgtcaacaagatcgtccgggtgatcttttttatccctgtgatcctctcggcgctagcgactggttacatcttccaagcgttgctgcgccccgacggcgggctcaaccaaatgctcggaatattcacgggatctccggtaaaagtctcctggctgggatcgacgacgtggactctgctcgtgtgcattgtcattcactcgtggaagtggatgggcatgtcgatgctcgtgtacctggccgggcttaagacgatcgatgcccaagtgctcgaggcggcacgcatcgacggggcgtcacggtgggcgaccttccaccagatccgcttgcctctcatcgccccagcggtgacgttcaacgtcgccaccgccttgctggggtcgatgaactccttcgatatcgtccaggcgactacgggcggaggccccggcggctccaccgaactgcttaacctcttcatcttccgaactttcggccagggcctctacgctcaggcgacgacgatgagcctggtgctcttcgtggccgtcgtcatcttggcattccccgtgatcgggatgcttcgtcgccgtgagggaaggatgtcatgaccaaacgcatcattcagccaattggcgcggtactgctagccgtgctcgtcgtcgggatacccctgtggacggtcgtcgtcactgcagggaagtcccaggccgaagcactcatcccggacatatcattgccacaccactggcaactgtggaccaacgtctccactgtcaccagccagacaaggatcggctgggcatatctgggctcgttgttcctgctggtgccctcggtggtcatcgtcttgatcatcggatcgatggcatcgtgggttttagctcggcgcacaggcaagctcgtctccgtgatctacgcgctggggatttcgggcatcatcctgccgccagcggtcgtcaccttggtgttactgctgcgtcagctgggattggctggccgccccatcggaatgatctgcgcctatgtcgggatgtacctgtcgacggtgattttcttcgtcactggattcgtccgcacgatacccgagtccctcgaggaggcggcccgaatcgatggagctggaccaatgcgcgtctttgtgacggtcatcctccccttgctgcgtccagtgctggcaactgcgacgattctcatcagcctgtacgtgtggaacgacgtcttctatgccttcttcgtcgtaggaggccggatggacaccttgccgctgaacttgtttacagtcgccagcgccggggtacacctcaataactggcatctcatcttcacctatgtgctgctcatgagcgtgccgatcgtgatgctgttcattgcattccagcgcagcattatttcaggcattacttcgggtgcggtcaagtaacccttcttactgcctggggccttcgatcggactggcgaaatctccacaacgctcaactggtagtgacagtgaggtctggatcctgcatgtcttcgtcgaaggggaagatcggacgacgcagatggttatggcccagacgcataaggtcctggtccacaccgccaggggtgagcgccatgatccaatcggcggccaagtcgtaaaggtccggctcgagatacccgatcttcaccacgactatgtcggtcgtccgagggtccagttgtacccgctcaaactgttccagggtcgtgtactgatcgcgccgagtcgtcacgatgacgctaagccccccgattcccagcactgccgtacgcaggccgccaggatcgtcaactaggcagcgcacctgggcactcaggtggatagggccaggcttgcgagtatcgacatgtccccctaaatccacctcaaccatgcccccgacgcccgcttcgtcagcacgtttcacgacctgtgggtcatagatggaagcatgaatcgcggagagctccccaccagtgatctcgggatgggccagcaatacagatagcgcaatcgtcacgtcatcagcaccgccagcgcccggattgtcccccgagtcggaaataacgaacggccgtcgcgaggacgccaccgccctgtctaccgcttgttcgatcccatcggtgggagcgacgaagacgaattcgcgacgcaccttccagaagaactgtgcaatctcgctcaccccgtcgcgtacgtggttctcgtcgtcaccgaacccgacgacggctgccgtgcatcgaggctggtcggcccaagcaaagccgatccacaccccaacatcggtaacaccgtcgtgagccgccacctcgggcaccatgtcgtagagcgaagccgccggttcgatcctggtggacgtcttttcaccgggtaacagaatcggcacggtgaccatcgccttgatcggtttgcccttcccggaacgcagtcgctcgcacaatgtccgagccgctctctcccgtgacacccacgcgtcctcgtgcggtgccatccgatagcaggtgagcaggtcgcagcccgcgaagagtttttcagagacgtttccgtgcaggtccatcgaggcactcaccattggctcgggaccaaccacgtcgcggatggcgctgatgagatctccctcaacgtcgtcgtagcccggcacgctcatggctccgtgaatgtcgaagaagatcccgtccacatgaccggccttcgccaggccgtcgcagatttcggcgcgccacttctcgtaggtcagacgttccacgggtcctcccggcagggctgagcagtgcaggatcggtacccactcaacgtcatggttccacggacgttttgtcggcacatcccactcctcgcctgcgatggcccggggcacctggtctatgccggggatcggggactcggtgatccacgggtatcgctccagcagtgtctggccgcgacgctgcgtgaagtcagcggccgtgctcatgtagggggtgaaagtactcgattcaatatgaagtccacaaatggctatacgtatcatcagcgattgccttcctgtgagatgggcatatgagagtcaagtatcgacatgccgatgagcggggcatcggctccgcaagcagaggtctcgatcacgagatcctcggtgcacatgggcaaacagcgctcgtacagttcactgcgtacgccagcgagcaaagaacccatctgcgacattgagccgcccaacacgatgcgaaccgggttgaggaagttaacaaggttggaaagcacctcaccaagacgcattccggcgtcacgcactaaggaaaccgcctggggatcgccgctgttctcggcagtcaccaactgtgaggttgtggaaatggacgagcccaaacggcccagctgccgtaggatcgcagcccccgatgccaccgtctccaaacacccggagttaccacaggtacacggtagggggttatcggtatgcacccgcagatgggtgatgtcgccagcaagaccgcgtgagcctcggtaagcgaccccgccgctgacccaaccagcacctatgccggtgccagctttaacgtagatgcaggagtcccggtgccgtccgcggcagttccactccccgattgtcgcggcacgagcgtcattctcgataactgatggcaccgcgagttcctgtgccaacatgccggcgatgtctttgccactccacccaggcatccgcgctgccccaacgacgtgaccactaccgtccaccgggccgggtaccgccaagccggctgaaaccaccgctccagggatctcgtcaccaagcttgtgccaccccttggccaaggctttgatcgtcttctccggaccgatctctatgtttatcttgatgtcgtcggtagcgagtagctcgccctcccgagacgctattgccaaccgggcatgatgctggccaagttctgcaacaaaggcattgccgactgctggtgcaacgcgcaatttagtgggacgacgaccaccggtggaatctgcgcacgcgtactcttcaacgactcgcgactcgagcaggtgtcgcaccgccgcgctcaccgtggaacgtggcatggaagtgctctcggcgatctcggcgcgagtcatacccggcgtttttcgaagaatcttgatgactcgctgcccaggcgcgctgcccagctgatcgtcagtgtgcccattcatgcccgtcgcgccaaggttggtgagctcaatatctgtcatcagcttcctcaatccgtcatcgtgcctgcccgacgtctcggcccacagtatgcccgcgtccggagatatgtgtagcaaaagtgataaaagctagattattttacattcgaagcatccgaagtcatcaccttgcgctactcttacggtagtaagggttcatcccaccaggcaacggaggctgagggaactcatgaagaaaccacgaaagagactgcttgtggtgaccgcagcagtggcagcaactctgttggttgcctcgtgctcgtatggcagtggcgaccccagtcgatctcaggcaagcggcggcgcgcaggacggcaacgtatccttcgcgaccaccacgcccaactggatcctcccggtgtccgcacccggaaagacgcagggtgagaacgccatgttcacccagctcatttaccccgccttgttctcctacaagctcgacgcgaagaacgagttcaacattgatgaacgccactcggtggccaaacctcccaccgtgtccgacgactcactcacctacaccatcacccttaaggaccgcacatggagcgacggcgtcaagctcactacgcgcgacatggagttctggtggaacatcgtcaccaacaacaccgacaagtgggcgtcctaccgcaaaggccagttccccgacaacgtcaaggctttcaagatcattgacgacaaggccttcaccatcaccacgactgagaagtacaacccggcatggttcatcaacaaccaactgaaccgccttgtgccaatgccagcccacgcctggtctaagaccagcgactccgacaagcccggtgagaaggaccgcacccctgccggagccaaggcaatcttcaaatacttgagcgccgcctcggaggacttacagaactacgacaccaacaaactctggaagacgactctcgggcccttccagctcggcaagtacaccccgaacggtaaggccaagctcgtcgccagtcctagctacgacggtgaagacaaggcgagcatttcgagcttcaccatgcagccgtacaccagtgacgacgctgagttcaacatcctgcgctccggaagcatcgactacggcttcatcccacccaactcgatgacccagcaaaagtacatcgagaaacagggctacaccgtcaaaccgtggtacggctggtcgatcacctacatgccgtttaacttcaacaacccgaagtccggcccgatattcgcccaaaaatatatccgtcaggcgatgcaacacctcattgatcaggaaggaatctccaagatcatctggaaccggactgcatcccccacctgcggcccggtaccccagcaacctggcaccgccggtagctccaaaggttgcgcctacgactacaaccctgcgaaagctgagaaactcctcaaagaccacggttggaatgtcactaaggacggaatcaccacctgtcaacaagccggggagggcgaaggccaatgcggcaaaggaatcaagcagggggccaagctttccttcaccgtgatctcccaatccggtttcacctcgaccacccacatgttcgccgaactcaagtcgagtttttccaacgtcggtatcaacttggagattcgagaggttcctgactcggtggctgagtcccaagcctgtaagcccaacgacacgaactgcaagtgggacctgtcattctttggttcgcagtcatcgtggtactacccggtctacgcgtccggtgagcggctcttccaaagcggtggcccggtaaacctgggcagctactccgacaagaaagccgacgagcttattgacgcgtccatgcgttcgaacgatcggacagccctcaaaacgtacaacgcctatctggctgaagacctgccggtgttatggatgccgaacccggtcaatcgcgtctcagcatggaaatccaacatccaaggaatcgatccacaggaccccatgctgtacctgtacccgcaggactggaccatcagatgacctcacgcagagtgagcccacgttactgaccccgcccgtttcacacggcgtcaccgggtcgccccggtgacgccaccccaacgtcccaatcacccatctcaggagggagcaaaggatgacgcgatacatcgcgcaacgcgtttttcaagcgctgatagtgctgttgctcgtcacgcttatcactttctccatccttcacgcacttccaggcggagcagctcgctcggctttgggactggacgccacccaagcgcagatcgacgcatacaaccatcagatgggttacgaccaacccttatggaagcagtacttcggctatctgatccagatcttccatggcgaattcggacactctttccgactcaacatgccggttgccgacgcgatcggtcagcggcttcctaagacgattgtcctcagtctcatgtcggcagtcgtcgccatcctcctcgcgatccctatcggcgctatccaagccgtcaagcgcaaccgcacggctgactacactctcaccgtcatcgccatgctggcatattccacaccattgttcttcctgggcctcgttctcatcatcctcttctcacaggtgtggccgatcttcccaccagaagcgccacaagggttcagcgtcggagaagttcttagccaagggcgatcgctcgtgctgcccaccacgacgctcgccatcgtcacgctggccgtgtacgcgcgctacatgcgttcctcgatgattgacaacctcgaggaaaactacatccgcaccgcccgcagtaagggaatcaccgagacaagagtcgtcatcgttcatgccctgcgcaactcgctgtttccgatcatcaccctactcggcatgcagttgccggccttgttctccggtgcgctggtagtggagtcgctgttcaactaccccggcatgggtctgttgttctggcaggcggcccagttccgcgactaccccatcctgctagcagtcaccatcatcatctcaatggccaccgtgctcggcgccctcatcgcagacatcctctatgccgtcgtcgatccgcggattcgttacggaggagcagaccgatgagcaccgagatcgctattcccgatcctcagagccgacgtcccgaatctgcccgtcccatgcgtcccggcacagcgcgacggaccagcagacgcaccagcctcttcaaacagggggtggaggtgttcttcgagaaccgtttggccgtcgtaggatttgtcaccctgcttatcatcgtcgttctgtgcttcatcggaccgtcgatctggcgcaccgatcaggtccacacccagctgtccagcgcttacctccccatctccggcacgcaccctcttggtacggacgcggtgggctacgaccagctcggacgactcatgctcggcggccagacatccatcatcgtcggcctggcagctggcatcctggccaccaccatcggaacgatttggggcgccacagccggattcgtcggaggatggttagacgctgcgatgatgcgaatcgttgactcactcatggctatcccggccttgttcctcttcatgctcatcgccacgctcgtcacaccgaccgtgcccttgttggtactcatcattggcgcatttgcttggctcaacccagctcggctcatccgcggtgagtcgctggctctgcgcagccgggaatacatcgtcgctatgcgtggcatgggcggtagctctctgcgcgccgtacgcactcacgttgtgcgtaatgccatcggcaccgtcatcgtcaatgcaaccttccaggtggcagacgccatcctctacgtcgcgtacctgtcatttctcggcctcggggttcccccaccagcggccaattggggcggcatgctttccgacgggctcgccgaggtctactcgggtcactggtggctgttatacccgcccggggtactcatcatcattctggttgtcgcgtttaacttcgtcggtgacggattacgggacgccttcgaggttcggctgaggagtagatgacatgagcatgtcacagcccgaagacatcttgctgcgtctgcaagatctggaggtcactattgacgtgcgcggtggcagggtcgcgcctttgcggggctgctccatggaagtacgacgcggcgagacgatcggtctagtcggcgagtccggatccggtaagacgatgacagcgctatccatcatgggcctgctcccccacggtggacgggttaccggaggatccatcgtcttcaacggcagggacctcactagttcgccacccgacgagacccggcgcattcgcggtatggacatcgggatgatcttccaagacccgctcacctcactcaacccgacgatgaaaatcggtaaccaagtaggcgaagcgctgagaatccacaaggtggcctcgaagaagaaggcttgggaacgctctatcgacctcctgcgcaaggtgggaatgccacgtccggaaaagatcgtcaatgactatccgcatcagctgtctggtggtatgcgtcagcgagtcatgatcgctatggcactcatctgctcacccagtcttctgatcgcggatgagccgacgacagctttggatgtaacgactcagcggcagatcctcgacctcattgacgacctcaagaaggagttcaacaccgccgtcatcctggtgacacacgatctgggagtagttgcgggccgggccgaccgggtagccgtcatgtatgcgggtcagatcgtcgaggtggcatcgtctaccgacattttcatcaacccccagcaccagtacacgcgctcgctcattgccgcactgcctgagcagaccaccgatacccgtgaggagctctacaccatccctgggatgccgccggacctgcgcgagaagatcgtcggctgcgccttcgctactcgttgcccgctggccactgagatctgcactcagtccaaccctcacatggtcaccctgggcagaaccgacgcgccaagtgccaacaacgaacccgccaaccatgtacatacctgcttccatccggcagggccgccgctgaagcgccgacacgacctacgcccggagcgagacctgtccagccaccccgttgtgtgctcagtgcaagatctccataaaaactaccctgccatgagcagcggcgtcatccggcgtcaaatcgggtgggtacgggccgtcagcggtgtcagctttgacgtctatgagggcgagacactggggatcgtcggtgaatccggttgtggtaaatcgaccttagggcgcgtcatcactgcgttggaaccagcgacctcaggctccgtgtgcatcaatggcaaggatattgctcaggcgtcacgcagggaacgcaccctcttgcaccgcaatgtacagatgatgtttcaggattcctacgccgcaatggatccgcgcatgcgagtagacgagatcctctccgagccccttagcatccaaaaaatcggagaccggcgttcgcgtgccgacgctgcggacaatctcatcgacaagatcgggctgtccgataacgccttgtcgaagtacccgcatcagttctctggtggccaattgcagcggatcggccttgcgcggtcactgatgctagaaccccatctcattgtctgtgatgagccagtcagtgccttggatgtatccgtccaggctcaagtgctcaatctcatgcgcaggctccagcaggagcagaacctcacctacatcttcatctcccacgacttgtctgtcgtcaggtacatgtcggatcgaattgccgtgatgtacttaggaaaaatcgtggaaataggtgaggctaacaaggtcgtcgaccacccacgtcacccgtatacgcgggcactgatcgaggcgatccccgttgctgaccccgcgcatcacgtggaggagatcgtgcgtctgcagggtgaaccagccagtgccatcgacacgcctccggggtgccgtttcaaaaatcgatgcccatttgccaccaacaagtgcgccgaagaacccccgttagtgggcgacactcaccgagtggcctgccacttccctctaccacacgacgtcttggaagtatcatgagccaccccggcgcctatcgaccggtcgtcgccatcgatattggcggcacaacgatgactattgccgaagtccgttccgacggaagcgtacgagatccggtgacaatggacagccccgcacgaatccatggcgacgaagtggtggcccgaatatgcgagcttgtcgagacccgctggccccatccgtgccggatcggcatagggaccgcaggagtcgtcgaccctatcagtggctcgatcggcagagcatccgactccttccaagggtggaccgggtacccactacgcgaacgtctggaagaggcccttggcgtggcggtccaagtggaaaacgacgtcaatgccttcctcgttggcgagcaacggttcggcgcagcggccggggagcgcgactgccttgggatcatgcttggtaccggtgtcggcggagccgtcatcctcgacggacaggtgattcatggtcggcgcggggccgcagccgaaatcggtcatatgcctgcgctaggaaacgatcgatgcagttgtggcgtccccggacacctcgagtcactcgctgggggaagggccatcgcccgacgctgggctgcggccactggacgggatcccaaatccgtcaatggcgcccgtgaggttgcccgccgggcggcaaacggcgatgctgtggcgccgcgaatactcgccgaagctggaaaagccctaggaatcgcactagtacaagccgcgaccctgtttgatctgagtacggtcatcgtcggaggaagcgtcgcaagggcatggcagtggctctcgcccggcctgcacgacgtcgtgacggcgtacccgttgatctccggggctgaattgcgggtgcgtcttgcctcgcttagcgaccgcgcggtcctcataggcgcagccagtcttggggtctgcgacgatcaatggacgaagccatgctgaacttcgacgaacgcaccggcccgaatcagggagtgaacgccccgcactggccgtcggtccaggtgcctcaatggtggaaagatgccaaactcggattcttcatccactggggcttgtactcggttcccgcctgggcgaccaccaatcccgacccggtaccacttgagcaggagtacgcccaccactgctacgccgagtggtatgcaaacacggtgcgcatcctcaactctcccactcgccgacatcacgacagggtatacgggatcggaacgagctatgaggacttcgccgactggtggagccccgacctagatgcacctgccacgctgatccgtcgaattgctgacgccggggccgggtacgtcatcccgacgacgaaacaccatgacggattctgtctgtggcataccgacacgaccggcttcaatgccgctaaacgaggaccgcaccaagatctcgtcaaggccttgcacgacgaggcgcgagcggcaggacttagattcggcgtctactattcgggagcgctcgactggcatgttggggacttcggggcgatcacctctgataccgagctgttcaccttccgccgcaacgaccccgacttcgccaaatactgcgccgctcaactcactgaacttatcgcacggttccgaccagacatattgtggaatgacattgagtggcccgatgcgggcaaggggagtcagccctacgggctcgccagcctgttcagccactacctgaagcaagtacctgagggggtcgtcaacgaccgctggggagtatcccaccacggattcctcactcgggagtaccgtcatgttgacgccaaaatcaacgaaccgtgggagtcgacgcgggggctcggacgttcttttggctacaaccaagaagagtcgacagacgagagccttagtggcaccgagctcgtccagtacctcgtggatgtcgtcgctaaaaacggaaatctgctcattaacgtcgggccacgcgctgacgggtctattcctgaggtgcaggccgctgcaatggccgaactcggacggtggatgagggtgcacgatgaagccattcggggtacccgaccctggggaaacggggtctacggtgaccagcgcatcgtcaagcgtggggaaactgtctacgtccatctgctcgacggggacgcgctccacctccctgacgagctccagggcttcgatgtcagctggatcggcagccagagcaagcagacctctgtgccatgcgagctcgttaaccagccggtcaaggtcgcgaggctcacccggtgaggatggatcccagtcatgtagtaaacaccgaccgcgataggacctcttagttgtgagggggatgggaccggcagagctatctcagtgaagcgattcccgggaggtcaccacacccggagcgcatcccgttcgtccatacgcagcggttgcagctttgagggcgtgtcctccgaggtccaatcgttgcgaccacgtacttatgcataaggtcg

SEQ ID NO: 73 - DNA, 18954 bp, Propionibacterium acnes
catcatgccgacgtcaaggatcggcgcggccatccaccgggggacacgctgaggctcgggtgatgagggtcgtaggaatctcgactgttccactgggatccgttccaagggcaagacgggccgcagtttctcccacggcggcgaaatcaagccgcaccgtcgtgagcgctggccgagtggccaccgaatggggatgatcatccatgccgacgaccgagacatcctcgggaactctcaaccccaacctgtcaagccctgttaagaggccgagagccacatcgtcgtttccacataggactgcggtcacctggtgcgctcgtaccgcccgtgcaacgtgcatacccgtctcgactgaccacccagtcgccaatggttcgagcggcgggagacctcgagtagccaggacttcgcgccatcccgcacatcgtggatcagggtgccctgcaggaggaactccgacataggcgatgcggcggtggcccaaacccgccaagtattcggtggccattactgcaccggcatgatcatcgatccacgcccgagaccagggctcgcctccctcgggtttgcctccggcaatggcaactgggagatcgacgggcaacccaggcaggagggccacgctgggggaatcaaattcaaggacgacaaccccgtcggcacgagcgtctaaggcacattgcacggtggaacggcatcgctccggcgaccccgccaatacatgtagggaggtctcggcaccgaggtcgagggctgcgctgagtacccccgagagcgtcgcccagtagccggtgcggccgatgtcggagacgagaacgtgcagccgggcgacgtcagggtcggtgcgccaatatcccagctcggtggccgcggtgaggatctcctcggtggcctgcgggagggcaccttcagcgccattctgacgtgccaaggcacgcgacgccgttgccaacgagacgccggagcgctcggcgacgtcagccaaccgcggaggccaccagggccgcctcaccatggccgggtcacgttccatgcaccggacgataccgggttcacacccctgtcctcggcaagggcgtccgcggaagaccagggcgcgacggggccgcatccgcggctgctgaggtggagcgagccggggtggacggaacgggaatcgacgtcgccgatgggccgggaagaggcgaggggatcgtcgtggtgagcgtccagaccgctgccgtggccaaatccgagccctcgaccacccggctgtcagctacgacgatcggcaggccggtgaactttgagtgcagggtacgccccgccccgtttgcaagcaggtgccagcggttgaggctgccctcagtatccgacgtcgtccgacgaccggacccgacgacgacctcgtgcttcccaacctcggcgtcgagaccaaggaccgcgccgccaggagtcgaaaggctgtaagtgcaatcgtcgtgccgaaccacacaccaagtctgaggctgcgcctgcagggtagggacaccgtcgtgaaatgccaagaatcgcccgtccgcgctagtcagccggtagtcgccgggctccagtgccgggttgggggcgtaccaagcgcgcacgtagtcgatgtcaaaactcgccgggagtcgatggacgactggggcccccaggtgtccctcaagactgagcaccatatgccgcgacatccgccacagcgaagggtcgccgggttttgtttcccaggccaggtgtcggtcgaaataaaatcggagttgaccgtcgcggcgttcgacgccatacgtgtggtagtcccgcgaaatgtcgacgccaaccgggtaggcgtggcctccgaagcgccggtgcgtgacctctgtgttatcgggccacacgtgggtcgcgatgttcatcttcgtgtagtcaaaagtctcctcgacgtcaagctccgggtttggctcggcgccggtaagcaaggaagggccaccgtcgagggcggacgactgcatccagatggccgacagcacccgggcggccgagggcaacgccttggcacgcacctcgacgtaggtgcacagacccggcacgtcaaagactgactcaacggcgccaaacgtgtaggaaaaactatcgacctgctcggcacgagcagccaaatggagttgcccgcctgagaaagacacattcgcgtctcgaaagaggccacttcccgagtgtgggtaccacaggccgcgatgccactgggccgagctgtgagtcggatcggtgaattcgtctccaacacccaggagggtccagccagcaaggtcgatatcggcatcggcggcgatagcccgatcgtggtcggcaaccaccggaacggccgccgtgagaacggcagctccgaggactgatctacgtgtgatcagtgtcatgtgtgctcctttgcaacaacgtcactccctaactggggttccatgcagcctacgacgaatgactgcggtcaccacgagcgcgtgaaaacggcctttcatgcgctgtggacggcccctttcccggcacctagggtgaacgacatcacgaacgacggccaatgtcggccagccaggagttcaccaccatgcacgatgtcacccctgtcatccagccgtttcggctcgcgacggcccccgaccaaccggtcggcttggcagccgggactcttgacggcgcggtggcgcttcccctcgtcgaatgcctcaccctcgaacacggccgatgcttcgtcgaccatcgcctcacccaaactacggtgggatccggtctgcgtcccgttcgccgcgaaccgctcacctcgccgtggcccggcacccgcgtcatccagcatgatcgaggatccgacctcaccgtcaccgtcgatctgtggcatcccacctcagcgaccttgcacgggcgaacaaccgtacataatgacggcaagctcccagtccatctcactgccgtctctatcatgtgcgccagtctgctgtcaggagccgaattcgatgacctcgatatactcatcgcacccagcgcatggatggccgaacaacggtggacccatcaccgcctgtccgatcttctggtggacgtcggcaccgaattgcatggagaatccccgcgcgaccgcttcgtcctatcctcagagtccggttggtcttcaggacgttgggaaccggtcggcttcattaccgacccggcctctggacgcgccgtcggctggcagatcgagcacaacggtggctggactgtcgaattagcccggcgctcttcaaccctcggcctctgcctcttcgggccgaccgaccttcagcaccactggatgcaccagctcaaccctggcgagactttcactacccccgcggtgacgttagtggtatccgataacagctggcagggcgcggcagccgaactaagcacctaccgccgtgtattgaggggcaacaatggcacagcagctccgatcgtcttcaacgactacatgaacaccctcatggccgaccctacggccgagcgactctcgaccctcatcccggccgcagctcgcaccggagccgaggtgtactgcatcgacgccggatggcactccgacgacacagactggtgggacgacgtcggccgctgggagccctcgccccgccgatttcccggcgggctgcgccacacccttgatctcatcgtcgcctacggcatgacgcccggcctgtggattgagccgctggcggttggtctgcgcagtcctctcgtcaatgatctacccccggaggctttcatgcgccgcgcaggggttccgatcgtcgaacagaatcgggtgcgtctagatatgcgcaatccgcaagctcgcgctcatctagataccgtcatcgaccggatggtcagttacggcatcggctacctcaaaattgatgacaatttctctgtcggttctggccccgacgaggacgcggattctcctggggacggtttgctggggcactgccgcgcttgggccgcctggcttgccgacctccctcgacgtcaccctggacttgtcgttgagaactgtgcatctgggggcatgaccaccgactacgccctgttggcccgagcagccatccagtcgacatcagacctccaggattcggtgcgttacccgcccatcgccgccaattcaccgatgacgattttgcccgaacaagccgccaattgggcttacccacagccagacatggacgacgaggaaatcgtctttaccgtcacgacctccttggccggcaccttttacttgtccggtcatgtcgaccgcatgaacgcccaccagatggctctcgtgcaatccggcgcagaggtagccaaggccttacggtcagatctgaccagccaaataccgtggtggccgaaaggccttgccggctgggacgacgagtgggtcgtcaccgggcgtcgaaaaaagtcctctcgcgacggggtgatcattgtctggcaccgtcctagcaccgaatcgacggttctcgacttacctgacctggctgggacccacctcgaacccctttacccacctgcctccctggtccccgacccaggaattcacattgctgactcatcgggttcacctcggctgagttgtccgtctcccaaaccaaccggccgggtcttccgcgtccgggaccttcacgattgcgtcaccgatgtcgcagaaatggagaagaaatgaatcgcaccctcaaggtcgccgcagtaggagccatcgcgatattgtgcctcgctgcctgctccgacccaggctcagactcggcgcaatcctcaggaccggagtcatggccgtcagcaaccaccaatctcaacggtgtggagttgacaatgtgggccgcccagtcgtcggcgtcgatccctcaacaggtcgccgtggacttcaacaaggctaccggggccaagatcaagatcgtcacgatccccgacccctacgagcagagcgtccagaccaaagtcgccaccggtgacgtccctgacctggccatgtggcagccaacgacgtcaatgctcacgagcctgggagccaaagagcatctgcaggtgctcgacgatgccccgtgggagtcgaagactgacaagaacgtcctggctgccggtggttctctcgacgggcaccgctacgccgccttcgtctcagccccctcggtcatgggcgtttggtacaacaaagaagttttcgccaagaacggcatccaggtgccgaagaatttcgacgagatgctcaccattgccaagaagctcaaggctgccggccagaccccgttctacgagatgggcggagagtggtgggcctcccagtgggcggtccaggtgcaggtggccgacgccgccaaggccggtctgtgggacaaggtcaacaagaacgaggacaagttcaccggcactgagatccaaggtgctatcaacacctacgacaccatgatcaaggaaggtctgttcaattcggacatcacaaccggaactttcaacgaccaagccaaggcgctgcttgacgggaaagcagcgatggccattcaagtaacgagcctattgggcaacatggccgcccgagccgacaccgccactctcgacaagaagatcgggttcttccccatctctaagtcgggcaccgtggcaacgtcgatccccgaccagaccaacgccgtggtcgccttcaaatcgaaggatgccaagaaggagactgcgacacgtcagttcatcacctactggttgtccaacgactacgcgtccttcgtcaaggtacaaaacaccgtttccatcattaacggtgttaaaacgcccgattccgtgcccaaagccctcatcgactcgaacgccaccctcaaaggttcggtcggctcgatgcagtctctggctgtcgccaaccccgacttagctaagaacctcggtgacatgatcgctggcacgaagactccagcacaggtgggctcagagactcagtctcagttcgcccagctcgccaaggcgattggcgcgaaagggttctgatccatatgtcctcgatggaagccgcaccgcgacacggcagtgcaaaccagtcgcatccctggggattcgttgtacccgcgttcgccgtgctcgcggtgttcttcctcacgccaacgatctacaacttcatctacgccttcaccgactggtcgagcttcaaaacggccatcaatccggtgggatggagcaatttctccgatctcatcgcatcaggaagcctgcggaaatccttgactatcacccttatttacgcggctggcgtggccacgctgcagaatctgttcggactgatgctggccgtactgttggagcgcgacaccctcgtcaacaagatcgtccgggtgatcttttttatccctgtgatcctctcggcgctagcgactggttacatcttccaagcgttgctgcgccccgacggcgggctcaaccaaatgctcggaatattcacgggatctccggtaaaagtctcctggctgggatcgacgacgtggactctgctcgtgtgcattgtcattcactcgtggaagtggatgggcatgtcgatgctcgtgtacctggccgggcttaagacgatcgatgcccaagtgctcgaggcggcacgcatcgacggggcgtcacggtgggcgaccttccaccagatccgcttgcctctcatcgccccagcggtgacgttcaacgtcgccaccgccttgctggggtcgatgaactccttcgatatcgtccaggcgactacgggcggaggccccggcggctccaccgaactgcttaacctcttcatcttccgaactttcggccagggcctctacgctcaggcgacgacgatgagcctggtgctcttcgtggccgtcgtcatcttggcattccccgtgatcgggatgcttcgtcgccgtgagggaaggatgtcatgaccaaacgcatcattcagccaattggcgcggtactgctagccgtgctcgtcgtcgggatacccctgtggacggtcgtcgtcactgcagggaagtcccaggccgaagcactcatcccggacatatcattgccacaccactggcaactgtggaccaacgtctccactgtcaccagccagacaaggatcggctgggcatatctgggctcgttgttcctgctggtgccctcggtggtcatcgtcttgatcatcggatcgatggcatcgtgggttttagctcggcgcacaggcaagctcgtctccgtgatctacgcgctggggacttcgggcatcatcctgccgccagcggtcgtcaccttggtgttactgctgcgtcagctgggattggctggccgccccatcggaatgatctgcgcctatgtcgggatgtacctgtcgacggtgattttcttcgtcactggattcgtccgcacgatacccgagtccctcgaggaggcggcccgaatcgatggagctggaccaatgcgcgtctttgtgacggtcatcctccccttgctgcgtccagtgctggcaactgcgacgattctcatcagcctgtacgtgtggaacgacgtcttctatgccttcttcgtcgtaggaggccggatggacaccttgccgctgaacttgtttacagtcgccagcgccggggtacacctcaataactggcatctcatcttcacctatgtgctgctcatgagcgtgccgatcgtgatgctgttcattgcattccagcgcagcattatttcaggcattacttcgggtgcggtcaagtaacccttcttactgcctggggccttcgatcggactggcgaaatctccacaacgctcaactggtagtgacagtgaggtctggatcctgcatgtcttcgtcgaaggggaagatcggacgacgcagatggttatggcccagacgcataaggtcctggtccacaccgccaggggtgagcgccatgatccaatcggcggccaagtcgtaaaggtccggctcgagatacccgatcttcaccacgactatgtcggtcgtccgagggtccagttgtacccgctcaaactgttccagggtcgtgtactgatcgcgccgagtcgtcacgatgacgctaagccccccgattcccagcactgccgtacgcaggccgccaggatcgtcaactaggcagcgcacctgggcactcaggtggatagggccaggcttgcgagtatcgacatgtccccctaaatccacctcaaccatgcccccgacgcccgcttcgtcagcacgtttcacgacctgtgggtcatagatggaagcatgaatcgcggagagctccccaccagtgatctcgggatgggccagcaatacagatagcgcaatcgtcacgtcatcagcaccgccagcgcccggattgtcccccgagtcggaaataacgaacggccgtcgcgaggacgccaccgccctgtctaccgcttgttcgatcccatcggtgggagcgacgaagacgaattcgcgacgcaccttccagaagaactgtgcaatctcgctcaccccgtcgcgtacgtggttctcgtcgtcaccgaacccgacgacggctgccgtgcatcgaggctggtcggcccaagcaaagccgatccacaccccaacatcggtaacaccgtcgtgagccgccacctcgggcaccatgtcgtagagcgaagccgccggttcgatcctggtggacgtcttttcaccgggtaacagaatcggcacggtgaccatcgccttgatcggtttgcccttcccggaacgcagtcgctcgcacaatgtccgagccgctctctcccgtgacacccacgcgtcctcgtgcggtgccatccgatagcaggtgagcaggtcgcagcccgcgaagagtttttcagagacgtttccgtgcaggtccatcgaggcactcaccattggctcgggaccaaccacgtcgcggatggcgctgatgagatctccctcaacgtcgtcgtagcccggcacgctcatggctccgtgaatgtcgaagaagatcccgtccacatgaccggccttcgccaggccgtcgcagatttcggcgcgccacttctcgtaggtcagacgttccacgggtcctcccggcagggctgagcagtgcaggatcggtacccactcaacgtcatggttccacggacgttttgtcggcacatcccactcctcgcctgcgatggcccggggcacctggtctatgccggggatcggggactcggtgatccacgggtatcgctccagcagtgtctggccgcgacgctgcgtgaagtcagcggccgtgctcatgtagggggtgaaagtactcgattcaatatgaagtccacaaatggctatacgtatcatcagcgattgccttcctgtgagatgggcatatgagagtcaagtatcgacatgccgatgagcggggcatcggctccgcaagcagaggtctcgatcacgagatcctcggtgcacatgggcaaacagcgctcgtacagttcactgcgtacgccagcgagcaaagaacccatctgcgacattgagccgcccaacacgatgcgaaccgggttgaggaagttaacaaggttggaaagcacctcaccaagacgcattccggcgtcacgcactaaggaaaccgcctggggatcgccgctgttctcggcagtcaccaactgtgaggttgtggaaatggacgagcccaaacggcccagctgccgtaggatcgcagcccccgatgccaccgtctccaaacacccggagttaccacaggtacacggtagggggttatcggtatgcacccgcagatgggtgatgtcgccagcaagaccgcgtgagcctcggtaagcgaccccgccgctgacccaaccagcacctatgccggtgccagctttaacgtagatgcaggagtcccggtgccgtccgcggcagttccactccccgattgtcgcggcacgagcgtcattctcgataactgatggcaccgcgagttcctgtgccaacatgccggcgatgtctttgccactccacccaggcatccgcgctgccccaacgacgtgaccactaccgtccaccgggccgggtaccgccaagccggctgaaaccaccgctccagggatctcgtcaccaagcttgtgccaccccttggccaaggctttgatcgtcttctccggaccgatctctatgtttatcttgatgtcgtcggtagcgagtagctcgccctcccgagacgctattgccaaccgggcatgatgctggccaagttctgcaacaaaggcattgccgactgctggtgcaacgcgcaatttagtgggacgacgaccaccggtggaatctgcgcacgcgtactcttcaacgactcgcgactcgagcaggtgtcgcaccgccgcgctcaccgtggaacgtggcatggaagtgctctcggcgatctcggcgcgagtcatacccggcgtttttcgaagaatcttgatgactcgctgcccaggcgcgctgcccagctgatcgtcagtgtgcccattcatgcccgtcgcgccaaggttggtgagctcaatatctgtcatcagcttcctcaatccgtcatcgtgcctgcccgacgtctcggcccacagtatgcccgcgtccggagatatgtgtagcaaaagtgataaaagctagattattttacattcgaagcatccgaagtcatcaccttgcgctactcttacggtagtaagggttcatcccaccaggcaacggaggctgagggaactcatgaagaaaccacgaaagagactgcttgtggtgaccgcagcagtggcagcaactctgttggttgcctcgtgctcgtatggcagtggcgaccccagtcgatctcaggcaagcggcggcgcgcaggacggcaacgtatccttcgcgaccaccacgcccaactggatcctcccggtgtccgcacccggaaagacgcagggtgagaacgccatgttcacccagctcatttaccccgccttgttctcctacaagctcgacgcgaagaacgagttcaacattgatgaacgccactcggtggccaaacctcccaccgtgtccgacgactcactcacctacaccatcacccttaaggaccgcacatggagcgacggcgtcaagctcactacgcgcgacatggagttctggtggaacatcgtcaccaacaacaccgacaagtgggcgtcctaccgcaaaggccagttccccgacaacgtcaaggctttcaagatcattgacgacaaggccttcaccatcaccacgactgagaagtacaacccggcatggttcatcaacaaccaactgaaccgccttgtgccaatgccagcccacgcctggtctaagaccagcgactccgacaagcccggtgagaaggaccgcacccctgccggagccaaggcaatcttcaaatacttgagcgccgcctcggaggacttacagaactacgacaccaacaaactctggaagacgactctcgggcccttccagctcggcaagtacaccccgaacggtaaggccaagctcgtcgccagtcctagctacgacggtgaagacaaggcgagcatttcgagcttcaccatgcagccgtacaccagtgacgacgctgagttcaacatcctgcgctccggaagcatcgactacggcttcatcccacccaactcgatgacccagcaaaagtacatcgagaaacagggctacaccgtcaaaccgtggtacggctggtcgatcacctacatgccgtttaacttcaacaacccgaagtccggcccgatattcgcccaaaaatatatccgtcaggcgatgcaacacctcattgatcaggaaggaatctccaagatcatctggaaccggactgcatcccccacctgcggcccggtaccccagcaacctggcaccgccggtagctccaaaggttgcgcctacgactacaaccctgcgaaagctgagaaactcctcaaagaccacggttggaatgtcactaaggacggaatcaccacctgtcaacaagccggggagggcgaaggccaatgcggcaaaggaatcaagcagggggccaagctttccttcaccgtgatctcccaatccggtttcacctcgaccacccacatgttcgccgaactcaagtcgagtttttccaacgtcggtatcaacttggagattcgagaggttcctgactcggtggctgagtcccaagcctgtaagcccaacgacacgaactgcaagtgggacctgtcattctttggttcgcagtcatcgtggtactacccggtctacgcgtccggtgagcggctcttccaaagcggtggcccggtaaacctgggcagctactccgacaagaaagccgacgagcttattgacgcgtccatgcgttcgaacgatcggacagccctcaaaacgtacaacgcctatctggctgaagacctgccggtgttatggatgccgaacccggtcaatcgcgtctcagcatggaaatccaacatccaaggaatcgatccacaggaccccatgctgtacctgtacccgcaggactggaccatcagatgacctcacgcagagtgagcccacgttactgaccccgcccgtttcacacggcgtcaccgggtcgccccggtgacgccaccccaacgtcccaatcacccatctcaggagggagcaaaggatgacgcgatacatcgcgcaacgcgtttttcaagcgctgatagtgctgttgctcgtcacgcttatcactttctccatccttcacgcacttccaggcggagcagctcgctcggctttgggactggacgccacccaagcgcagatcgacgcatacaaccatcagatgggttacgaccaacccttatggaagcagtacttcggctatctgatccagatcttccatggcgaattcggacactctttccgactcaacatgccggttgccgacgcgatcggtcagcggcttcctaagacgattgtcctcagtctcatgtcggcagtcgtcgccatcctcctcgcgatccctatcggcgctatccaagccgtcaagcgcaaccgcacggctgactacactctcaccgtcatcgccatgctggcatattccacaccattgttcttcctgggcctcgttctcatcatcctcttctcacaggtgtggccgatcttcccaccagaagcgccacaagggttcagcgtcggagaagttcttagccaagggcgatcgctcgtgctgcccaccacgacgctcgccatcgtcacgctggccgtgtacgcgcgctacatgcgttcctcgatgattgacaacctcgaggaaaactacatccgcaccgcccgcagtaagggaatcaccgagacaagagtcgtcatcgttcatgccctgcgcaactcgctgtttccgatcatcaccctactcggcatgcagttgccggccttgttctccggtgcgctggtagtggagtcgctgttcaactaccccggcatgggtctgttgttctggcaggcggcccagttccgcgactaccccatcctgctagcagtcaccatcatcatctcaatggccaccgtgctcggcgccctcatcgcagacatcctctatgccgtcgtcgatccgcggattcgttacggaggagcagaccgatgagcaccgagatcgctattcccgatcctcagagccgacgtcccgaatctgcccgtcccatgcgtcccggcacagcgcgacggaccagcagacgcaccagcctcttcaaacagggggtggaggtgttcttcgagaaccgtttggccgtcgtaggatttgtcaccctgcttatcatcgtcgttctgtgcttcatcggaccgtcgatctggcgcaccgatcaggtccacacccagctgtccagcgcttacctccccatctccggcacgcaccctcttggtacggacgcggtgggctacgaccagctcggacgactcatgctcggcggccagacatccatcatcgtcggcctggcagctggcatcctggccaccaccatcggaacgatttggggcgccacagccggattcgtcggaggatggttagacgctgcgatgatgcgaatcgttgactcactcatggctatcccggccttgttcctcttcatgctcatcgccacgctcgtcacaccgaccgtgcccttgttggtactcatcattggcgcatttgcttggctcaacccagctcggctcatccgcggtgagtcgctggctctgcgcagccgggaatacatcgtcgctatgcgtggcatgggcggtagctctctgcgcgccgtacgcactcacgttgtgcgtaatgccatcggcaccgtcatcgtcaatgcaaccttccaggtggcagacgccatcctctacgtcgcgtacctgtcatttctcggcctcggggttcccccaccagcggccaattggggcggcatgctttccgacgggctcgccgaggtctactcgggtcactggtggctgttatacccgcccggggtactcatcatcattctggttgtcgcgtttaacttcgtcggtgacggattacgggacgccttcgaggttcggctgaggagtagatgacatgagcatgtcacagcccgaagacatcttgctgcgtctgcaagatctggaggtcactattgacgtgcgcggtggcagggtcgcgcctttgcggggctgctccatggaagtacgacgcggcgagacgatcggtctagtcggcgagtccggatccggtaagacgatgacagcgctatccatcatgggcctgctcccccacggtggacgggttaccggaggatccatcgtcttcaacggcagggacctcactagttcgccacccgacgagacccggcgcattcgcggtatggacatcgggatgatcttccaagacccgctcacctcactcaacccgacgatgaaaatcggtaaccaagtaggcgaagcgctgagaatccacaaggtggcctcgaagaagaaggcttgggaacgctctatcgacctcctgcgcaaggtgggaatgccacgtccggaaaagatcgtcaatgactatccgcatcagctgtctggtggtatgcgtcagcgagtcatgatcgctatggcactcatctgctcacccagtcttctgatcgcggatgagccgacgacagctttggatgtaacgactcagcggcagatcctcgacctcattgacgacctcaagaaggagttcaacaccgccgtcatcctggtgacacacgatctgggagtagttgcgggccgggccgaccgggtagccgtcatgtatgcgggtcagatcgtcgaggtggcatcgtctaccgacattttcatcaacccccagcaccagtacacgcgctcgctcattgccgcactgcctgagcagaccaccgatacccgtgaggagctctacaccatccctgggatgccgccggacctgcgcgagaagatcgtcggctgcgccttcgctactcgttgcccgctggccactgagatctgcactcagtccaaccctcacatggtcaccctgggcagaaccgacgcgccaagtgccaacaacgaacccgccaaccatgtacatacctgcttccatccggcagggccgccgctgaagcgccgacacgacctacgcccggagcgagacctgtccagccaccccgttgtgtgctcagtgcaagatctccataaaaactaccctgccatgagcagcggcgtcatccggcgtcaaatcgggtgggtacgggccgtcagcggtgtcagctttgacgtctatgagggcgagacactggggatcgtcggtgaatccggttgtggtaaatcgaccttagggcgcgtcatcactgcgttggaaccagcgacctcaggctccgtgtgcatcaatggcaaggatattgctcaggcgtcacgcagggaacgcaccctcttgcaccgcaatgtacagatgatgtttcaggattcctacgccgcaatggatccgcgcatgcgagtagacgagatcctctccgagccccttagcatccaaaaaatcggagaccggcgttcgcgtgccgacgctgcggacaatctcatcgacaagatcgggctgtccgataacgccttgtcgaagtacccgcatcagttctctggtggccaattgcagcggatcggccttgcgcggtcactgatgctagaaccccatctcattgtctgtgatgagccagtcagtgccttggatgtatccgtccaggctcaagtgctcaatctcatgcgcaggctccagcaggagcagaacctcacctacatcttcatctcccacgacttgtctgtcgtcaggtacatgtcggatcgaattgccgtgatgtacttaggaaaaatcgtggaaataggtgaggctaacaaggtcgtcgaccacccacgtcacccgtatacgcgggcactgatcgaggcgatccccgttgctgaccccgcgcatcacgtggaggagatcgtgcgtctgcagggtgaaccagccagtgccatcgacacgcctccggggtgccgtttcaaaaatcgatgcccatttgccaccaacaagtgcgccgaagaacccccgttagtgggcgacactcaccgagtggcctgccacttccctctaccacacgacgtcttggaagtatcatgagccaccccggcgcctatcgaccggtcgtcgccatcgatattggcggcacaacgatgactattgccgaagtccgttccgacggaagcgtacgagatccggtgacaatggacagccccgcacgaatccatggcgacgaagtggtggcccgaatatgcgagcttgtcgagacccgctggccccatccgtgccggatcggcatagggaccgcaggagtcgtcgaccctatcagtggctcgatcggcagagcatccgactccttccaagggtggaccgggtacccactacgcgaacgtctggaagaggcccttggcgtggcggtccaagtggaaaacgacgtcaatgccttcctcgttggcgagcaacggttcggcgcagcggccggggagcgcgactgccttgggatcatgcttggtaccggtgtcggcggagccgtcatcctcgacggacaggtgattcatggtcggcgcggggccgcagccgaaatcggtcatatgcctgcgctaggaaacgatcgatgcagttgtggcgtccccggacacctcgagtcactcgctgggggaagggccatcgcccgacgctgggctgcggccactggacgggatcccaaatccgtcaatggcgcccgtgaggttgcccgccgggcggcaaacggcgatgctgtggcgccgcgaatactcgccgaagctggaaaagccctaggaatcgcactagtacaagccgcgaccctgtttgatctgagtacggtcatcgtcggaggaagcgtcgcaagggcatggcagtggctctcgcccggcctgcacgacgtcgtgacggcgtacccgttgatctccggggctgaattgcgggtgcgtcttgcctcgcttagcgaccgcgcggtcctcataggcgcagccagtcttggggtctgcgacgatcaatggacgaagccatgctgaacttcgacgaacgcaccggcccgaatcagggagtgaacgccccgcactggccgtcggtccaggtgcctcaatggtggaaagatgccaaactcggattcttcatccactggggcttgtactcggttcccgcctgggcgaccaccaatcccgacccggtaccacttgagcaggagtacgcccaccactgctacgccgagtggtatgcaaacacggtgcgcatcctcaactctcccactcgccgacatcacgacagggtatacgggatcggaacgagctatgaggacttcgccgactggtggagccccgacctagatgcacctgccacgctgatccgtcgaattgctgacgccggggccgggtacgtcatcccgacgacgaaacaccatgacggattctgtctgtggcataccgacacgaccggcttcaatgccgctaaacgaggaccgcaccaagatctcgtcaaggccttgcacgacgaggcgcgagcggcaggacttagattcggcgtctactattcgggagcgctcgactggcatgttggggacttcggggcgatcacctctgataccgagctgttcaccttccgccgcaacgaccccgacttcgccaaatactgcgccgctcaactcactgaacttatcgcacggttccgaccagacatattgtggaatgacattgagtggcccgatgcgggcaaggggagtcagccctacgggctcgccagcctgttcagccactacctgaagcaagtacctgagggggtcgtcaacgaccgctggggagtatcccaccacggattcctcactcgggagtaccgtcatgttgacgccaaaatcaacgaaccgtgggagtcgacgcgggggctcggacgttcttttggctacaaccaagaagagtcgacagacgagagccttagtggcaccgagctcgtccagtacctcgtggatgtcgtcgctaaaaacggaaatctgctcattaacgtcgggccacgcgctgacgggtctattcctgaggtgcaggccgctgcaatggccgaactcggacggtggatgagggtgcacgatgaagccattcggggtacccgaccctggggaaacggggtctacggtgaccagcgcatcgtcaagcgtggggaaactgtctacgtccatctgctcgacggggacgcgctccacctccctgacgagctccagggcttcgatgtcagctggatcggcagccagagcaagcagacctctgtgccatgcgagctcgttaaccagccggtcaaggtcgcgaggctcacccggtgaggatggatcccagtcatgtagtaaacaccgaccgcgataggacctcttagttgtgagggggatgggaccggcagagctatctcagtgaagcgattcccgggaggtcaccacacccggagcgcatcccgttcgtccatacgcagcggttgcagctttgagggcgtgtcctccgaggtccaatcgttgcgaccacgtacttatgcataaggtcg

SEQ ID NO: 74 - DNA, 18955 bp, Propionibacterium acnes
catcatgccgacgtcaaggatcggcgcggccatccaccgggggacacgctgaggctcgggtgatgagggtcgtaggaatctcgactgttccactgggatccgttccaagggcaagacgggccgcagtttctcccacggcggcgaaatcaagccgcaccgtcgtgagcgctggccgagtggccaccgaatggggatgatcatccatgccgacgaccgagacatcctcgggaactctcaaccccaacctgtcaagccctgttaagaggccgagagccacatcgtcgtttccacataggactgcggtcacctggtgcgctcgtaccgcccgtgcaacgtgcatacccgtctcgactgaccacccagtcgccaatggttcgagcggcgggagacctcgagtagccaggacttcgcgccatcccgcacatcgtggatcagggtgccctgcaggaggaactccgacataggcgatgcggcggtggcccaaacccgccaagtattcggtggccattactgcaccggcatgatcatcgatccacgcccgagaccagggctcgcctccctcgggtttgcctccggcaatggcaactgggagatcgacgggcaacccaggcaggagggccacgctgggggaatcaaattcaaggacgacaaccccgtcggcacgagcgtctaaggcacattgcacggtggaacggcatcgctccggcgaccccgccaatacatgtagggaggtctcggcaccgaggtcgagggctgcgctgagtacccccgagagcgtcgcccagtagccggtgcggccgatgtcggagacgagaacgtgcagccgggcgacgtcagggtcggtgcgccaatatcccagctcggtggccgcggtgaggatctcctcggtggcctgcgggagggcaccttcagcgccattctgacgtgccaaggcacgcgacgccgttgccaacgagacgccggagcgctcggcgacgtcagccaaccgcggaggccaccagggccgcctcaccatggccgggtcacgttccatgcaccggacgataccgggttcacacccctgtcctcggcaagggcgtccgcggaagaccagggcgcgacggggccgcatccgcggctgctgaggtggagcgagccggggtggacggaacgggaatcgacgtcgccgataggccgggaagaggcgaggggatcgtcgtggtgagcgtccagaccgctgccgtggccaaatccgagccctcgaccacccggctgtcagctacgacgatcggcaggccggtgaactttgagtgcagggtacgccccgccccgtttgcaagcaggtgccagcggttgaggctgccctcagtatccgacgtcgtccgacgaccggacccgacgacgacctcgtgcttcccaacctcggcgtcgagaccaaggaccgcgccgccaggagtcgaaaggctgtaagtgcaatcgtcgtgccgaaccacacaccaagtctgaggctgcgcctgcagggtagggacaccgtcgtgaaatgccaagaatcgcccgtccgcgctagtcagccggtagtcgccgggctccagtgccgggttgggggcgtaccaagcgcgcacgtagtcgatgtcaaaactcgccgggagtcgatggacgactggggcccccaggtgtccctcaagactgagcaccatatgccgcgacatccgccacagcgaagggtcgccgggttttgtttcccaggccaggtgtcggtcgaaataaaatcggagttgaccgtcgcggcgttcgacgccatacgtgtggtagtcccgcgaaatgtcgacgccaaccgggtaggcgtggcctccgaagcgccggtgcgtgacctctgtgttatcgggccacacgtgggtcgcgatgttcatcttcgtgtagtcaaaagtctcctcgacgtcaagctccgggtttggctcggcgccggtaagcaaggaagggccaccgtcgagggcggacgactgcatccagatggccgacagcacccgggcggccgagggcaacgccttggcacgcacctcgacgtaggtgcacagacccggcacgtcaaagactgactcaacggcgccaaacgtgtaggaaaaactatcgacctgctcggcacgagcagccaaatggagttgcccgcctgagaaagacacattcgcgtctcgaaagaggccacttcccgagtgtgggtaccacaggccgcgatgccactgggccgagctgtgagtcggatcggtgaattcgtctccaacacccaggagggtccagccagcaaggtcgatatcggcatcggcggcgatagcccgatcgtggtcggcaaccaccggaacggccgccgtgagaacggcagctccgaggactgatctacgtgtgatcagtgtcatgtgtgctcctttgcaacaacgtcactccctaactggggttccatgcagcctacgacgaatgactgcggtcaccacgagcgcgtgaaaacggcctttcatgcgctgtggacggcccctttcccggcacctagggtgaacgacatcacgaacgacggccaatgtcggccagccaggagttcaccaccatgcacgatgtcacccctgtcatccagccgtttcggctcgcgacggcccccgaccaaccggtcggcttggcagccgggactcttgacggcgcggtggcgcttcccctcgtcgaatgcctcaccctcgaacacggccgatgcttcgtcgaccatcgcctcacccaaactacggtgggatccggtctgcgtcccgttcgccgcgaaccgctcacctcgccgtggcccggcacccgcgtcatccagcatgatcgaggatccgacctcaccgtcaccgtcgatctgtggcatcccacctcagcgaccttgcacgggcgaacaaccgtacataatgacggcaagctcccagtccatctcactgccgtctctatcatgtgcgccagtctgctgtcaggagccgaactcgatgacctcgatatactcatcgcacccagcgcatggatggccgaacaacggtggacccatcaccgcctgtccgatcttctggtggacgtcggcaccgaattgcatggagaatccccgcgcgaccgcttcgtcctatcctcagagtccggttggtcttcaggacgttgggaaccggtcggcttcattaccgacccggcctctggacgcgccgtcggctggcagatcgagcacaacggtggctggactgtcgaattagcccggcgctcttcaaccctcggcctctgcctcttcgggccgaccgaccttcagcaccactggatgcaccagctcaaccctggcgagactttcactacccccgcggtgacgttagtggtatccgataacagctggcagggcgcggcagccgaactaagcacctaccgccgtgtattgaggggcaacaatggcacagcagctccgatcgtcttcaacgactacatgaacaccctcatggccgaccctacggccgagcgactctcgaccctcatcccggccgcagctcgcaccggagccgaggtgtactgcatcgacgccggatggcactccgacgacacagactggtgggacgacgtcggccgctgggagccctcgccccgccgatttcccggcgggctgcgccacacccttgatctcatcgtcgcctacggcatgacgcccggcctgtggattgagccgctggcggttggtctgcgcagtcctctcgtcaatgatctacccccggaggctttcatgcgccgcgcaggggttccgatcgtcgaacagaatcgggtgcgtctagatatgcgcaatccgcaagctcgcgctcatctagataccgtcatcgaccggatggtcagttacggcatcggctacctcaaaattgatgacaatttctctgtcggttctggccccgacgaggacgcggattctcctggggacggtttgctggggcactgccgcgcttgggccgcctggcttgccgacctccctcgacgtcaccctggacttgtcgttgagaactgtgcatctggggggcatgaccaccgactacgccctgttggcccgagcagccatccagtcgacatcagacctccaggattcggtgcgttacccgcccatcgccgccaattcaccgatgacgattttgcccgaacaagccgccaattgggcttacccacagccagacatggacgacgaggaaatcgtctttaccgtcacgacctccttggccggcaccttttacttgtccggtcatgtcgaccgcatgaacgcccaccagatggctctcgtgcaatccggcgcagaggtagccaaggccttacggtcagatctgaccagccaaataccgtggtggccgaaaggccttgccggctgggacgacgagtgggtcgtcaccgggcgtcgaaaaaagtcctctcgcgacggggtgatcattgtctggcaccgtcctagcaccgaatcgacggttctcgacttacctgacctggctgggacccacctcgaacccctttacccacctgcctccctggtccccgacccaggaattcacattgctgactcatcgggttcacctcggctgagttgtccgtctcccaaaccaaccggccgggtcttccgcgtccgggaccttcacgattgcgtcaccgatgtcgcagaaatggagaagaaatgaatcgcaccctcaaggtcgccgcagtaggagccatcgcgatattgtgcctcgctgcctgctccgacccaggctcagactcggcgcaatcctcaggaccggagtcatggccgtcagcaaccaccaatctcaacggtgtggagttgacaatgtgggccgcccagtcgtcggcgtcgatccctcaacaggtcgccgtggacttcaacaaggctaccggggccaagatcaagatcgtcacgatccccgacccctacgagcagagcgtccagaccaaagtcgccaccggtgacgtccctgacctggccatgtggcagccaacgacgtcaatgctcacgagcctgggagccaaagagcatctgcaggtgctcgacgatgccccgtgggagtcgaagactgacaagaacgtcctggctgccggtggttctctcgacgggcaccgctacgccgccttcgtctcagccccctcggtcatgggcgtttggtacaacaaagaagttttcgccaagaacggcatccaggtgccgaagaatttcgacgagatgctcaccattgccaagaagctcaaggctgccggccagaccccgttctacgagatgggcggagagtggtgggcctcccagtgggcggtccaggtgcaggtggccgacgccgccaaggccggtctgtgggacaaggtcaacaagaacgaggacaagttcaccggcactgagatccaaggtgctatcaacacctacgacaccatgatcaaggaaggtctgttcaattcggacatcacaaccggaactttcaacgaccaagccaaggcgctgcttgacgggaaagcagcgatggccattcaagtaacgagcctattgggcaacatggccgcccgagccgacaccgccactctcgacaagaagatcgggttcttccccatctctaagtcgggcaccgtggcaacgtcgatccccgaccagaccaacgccgtggtcgccttcaaatcgaaggatgccaagaaggagactgcgacacgtcagttcatcacctactggttgtccaacgactacgcgtccttcgtcaaggtacaaaacaccgtttccatcattaacggtgttaaaacgcccgattccgtgcccaaagccctcatcgactcgaacgccaccctcaaaggttcggtcggctcgatgcagtctctggctgtcgccaaccccgacttagctaagaacctcggtgacatgatcgctggcacgaagactccagcacaggtgggctcagagactcagtctcagttcgcccagctcgccaaggcgattggcgcgaaagggttctgatccatatgtcctcgatggaagccgcaccgcgacacggcagtgcaaaccagtcgcatccctggggattcgttgtacccgcgttcgccgtgctcgcggtgttcttcctcacgccaacgatctacaacttcatctacgccttcaccgactggtcgagcttcaaaacggccatcaatccggtgggatggagcaatttctccgatctcatcgcatcaggaagcctgcggaaatccttgactatcacccttatttacgcggctggcgtggccacgctgcagaatctgttcggactgatgctggccgtactgttggagcgcgacaccctcgtcaacaagatcgtccgggtgatcttttttatccctgtgatcctctcggcgctagcgactggttacatcttccaagcgttgctgcgccccgacggcgggctcaaccaaatgctcggaatattcacgggatctccggtaaaagtctcctggctgggatcgacgacgtggactctgctcgtgtgcattgtcattcactcgtggaagtggatgggcatgtcgatgctcgtgtacctggccgggcttaagacgatcgatgcccaagtgctcgaggcggcacgcatcgacggggcgtcacggtgggcgaccttccaccagatccgcttgcctctcatcgccccagcggtgacgttcaacgtcgccaccgccttgctggggtcgatgaactccttcgatatcgtccaggcgactacgggcggaggccccggcggctccaccgaactgcttaacctcttcatcttccgaactttcggccagggcctctacgctcaggcgacgacgatgagcctggtgctcttcgtggccgtcgtcatcttggcattccccgtgatcgggatgcttcgtcgccgtgagggaaggatgtcatgaccaaacgcatcattcagccaattggcgcggtactgctagccgtgctcgtcgtcgggatacccctgtggacggtcgtcgtcactgcagggaagtcccaggccgaagcactcatcccggacatatcattgccacaccactggcaactgtggaccaacgtctccactgtcaccagccagacaaggatcggctgggcatatctgggctcgttgttcctgctggtgccctcggtggtcatcgtcttgatcatcggatcgatggcatcgtgggttttagctcggcgcacaggcaagctcgtctccgtgatctacgcgctggggatttcgggcatcatcctgccgccagcggtcgtcaccttggtgttactgctgcgtcagctgggattggctggccgccccatcggaatgatctgcgcctatgtcgggatgtacctgtcgacggtgattttcttcgtcactggattcgtccgcacgatacccgagtccctcgaggaggcggcccgaatcgatggagctggaccaatgcgcgtctttgtgacggtcatcctccccttgctgcgtccagtgctggcaactgcgacgattctcatcagcctgtacgtgtggaacgacgtcttctatgccttcttcgtcgtaggaggccggatggacaccttgccgctgaacttgtttacagtcgccagcgccggggtacacctcaataactggcatctcatcttcacctatgtgctgctcatgagcgtgccgatcgtgatgctgttcattgcattccagcgcagcattatttcaggcattacttcgggtgcggtcaagtaacccttcttactgcctggggccttcgatcggactggcgaaatctccacaacgctcaactggtagtgacagtgaggtctggatcctgcatgtcttcgtcgaaggggaagatcggacgacgcagatggttatggcccagacgcataaggtcctggtccacaccgccaggggtgagcgccatgatccaatcggcggccaagtcgtaaaggtccggctcgagatacccgatcttcaccacgactatgtcggtcgtccgagggtccagttgtacccgctcaaactgttccagggtcgtgtactgatcgcgccgagtcgtcacgatgacgctaagccccccgattcccagcactgccgtacgcaggccgccaggatcgtcaactaggcagcgcacctgggcactcaggtggatagggccaggcttgcgagtatcgacatgtccccctaaatccacctcaaccatgcccccgacgcccgcttcgtcagcacgtttcacgacctgtgggtcatagatggaagcatgaatcgcggagagctccccaccagtgatctcgggatgggccagcaatacagatagcgcaatcgtcacgtcatcagcaccgccagcgcccggattgtcccccgagtcggaaataacgaacggccgtcgcgaggacgccaccgccctgtctaccgcttgttcgatcccatcggtgggagcgacgaagacgaattcgcgacgcaccttccagaagaactgtgcaatctcgctcaccccgtcgcgtacgtggttctcgtcgtcaccgaacccgacgacggctgccgtgcatcgaggctggtcggcccaagcaaagccgatccacaccccaacatcggtaacaccgtcgtgagccgccacctcgggcaccatgtcgtagagcgaagccgccggttcgatcctggtggacgtcttttcaccgggtaacagaatcggcacggtgaccatcgccttgatcggtttgcccttcccggaacgcagtcgctcgcacaatgtccgagccgctctctcccgtgacacccacgcgtcctcgtgcggtgccatccgatagcaggtgagcaggtcgcagcccgcgaagagtttttcagagacgtttccgtgcaggtccatcgaggcactcaccattggctcgggaccaaccacgtcgcggatggcgctgatgagatctccctcaacgtcgtcgtagcccggcacgctcatggctccgtgaatgtcgaagaagatcccgtccacatgaccggccttcgccaggccgtcgcagatttcggcgcgccacttctcgtaggtcagacgttccacgggtcctcccggcagggctgagcagtgcaggatcggtacccactcaacgtcatggttccacggacgttttgtcggcacatcccactcctcgcctgcgatggcccggggcacctggtctatgccggggatcggggactcggtgatccacgggtatcgctccagcagtgtctggccgcgacgctgcgtgaagtcagcggccgtgctcatgtagggggtgaaagtactcgattcaatatgaagtccacaaatggctatacgtatcatcagcgattgccttcctgtgagatgggcatatgagagtcaagtatcgacatgccgatgagcggggcatcggctccgcaagcagaggtctcgatcacgagatcctcggtgcacatgggcaaacagcgctcgtacagttcactgcgtacgccagcgagcaaagaacccatctgcgacattgagccgcccaacacgatgcgaaccgggttgaggaagttaacaaggttggaaagcacctcaccaagacgcattccggcgtcacgcactaaggaaaccgcctggggatcgccgctgttctcggcagtcaccaactgtgaggttgtggaaatggacgagcccaaacggcccagctgccgtaggatcgcagcccccgatgccaccgtctccaaacacccggagttaccacaggtacacggtagggggttatcggtatgcacccgcagatgggtgatgtcgccagcaagaccgcgtgagcctcggtaagcgaccccgccgctgacccaaccagcacctatgccggtgccagctttaacgtagatgcaggagtcccggtgccgtccgcggcagttccactccccgattgtcgcggcacgagcgtcattctcgataactgatggcaccgcgagttcctgtgccaacatgccggcgatgtctttgccactccacccaggcatccgcgctgccccaacgacgtgaccactaccgtccaccgggccgggtaccgccaagccggctgaaaccaccgctccagggatctcgtcaccaagcttgtgccaccccttggccaaggctttgatcgtcttctccggaccgatctctatgtttatcttgatgtcgtcggtagcgagtagctcgccctcccgagacgctattgccaaccgggcatgatgctggccaagttctgcaacaaaggcattgccgactgctggtgcaacgcgcaatttagtgggacgacgaccaccggtggaatctgcgcacgcgtactcttcaacgactcgcgactcgagcaggtgtcgcaccgccgcgctcaccgtggaacgtggcatggaagtgctctcggcgatctcggcgcgagtcatacccggcgtttttcgaagaatcttgatgactcgctgcccaggcgcgctgcccagctgatcgtcagtgtgcccattcatgcccgtcgcgccaaggttggtgagctcaatatctgtcatcagcttcctcaatccgtcatcgtgcctgcccgacgtctcggcccacagtatgcccgcgtccggagatatgtgtagcaaaagtgataaaagctagattattttacattcgaagcatccgaagtcatcaccttgcgctactcttacggtagtaagggttcatcccaccaggcaacggaggctgagggaactcatgaagaaaccacgaaagagactgcttgtggtgaccgcagcagtggcagcaactctgttggttgcctcgtgctcgtatggcagtggcgaccccagtcgatctcaggcaagcggcggcgcgcaggacggcaacgtatccttcgcgaccaccacgcccaactggatcctcccggtgtccgcacccggaaagacgcagggtgagaacgccatgttcacccagctcatttaccccgccttgttctcctacaagctcgacgcgaagaacgagttcaacattgatgaacgccactcggtggccaaacctcccaccgtgtccgacgactcactcacctacaccatcacccttaaggaccgcacatggagcgacggcgtcaagctcactacgcgcgacatggagttctggtggaacatcgtcaccaacaacaccgacaagtgggcgtcctaccgcaaaggccagttccccgacaacgtcaaggctttcaagatcattgacgacaaggccttcaccatcaccacgactgagaagtacaacccggcatggttcatcaacaaccaactgaaccgccttgtgccaatgccagcccacgcctggtctaagaccagcgactccgacaagcccggtgagaaggaccgcacccctgccggagccaaggcaatcttcaaatacttgagcgccgcctcggaggacttacagaactacgacaccaacaaactctggaagacgactctcgggcccttccagctcggcaagtacaccccgaacggtaaggccaagctcgtcgccagtcctagctacgacggtgaagacaaggcgagcatttcgagcttcaccatgcagccgtacaccagtgacgacgctgagttcaacatcctgcgctccggaagcatcgactacggcttcatcccacccaactcgatgacccagcaaaagtacatcgagaaacagggctacaccgtcaaaccgtggtacggctggtcgatcacctacatgccgtttaacttcaacaacccgaagtccggcccgatattcgcccaaaaatatatccgtcaggcgatgcaacacctcattgatcaggaaggaatctccaagatcatctggaaccggactgcatcccccacctgcggcccggtaccccagcaacctggcaccgccggtagctccaaaggttgcgcctacgactacaaccctgcgaaagctgagaaactcctcaaagaccacggttggaatgtcactaaggacggaatcaccacctgtcaacaagccggggagggcgaaggccaatgcggcaaaggaatcaagcagggggccaagctttccttcaccgtgatctcccaatccggtttcacctcgaccacccacatgttcgccgaactcaagtcgagtttttccaacgtcggtatcaacttggagattcgagaggttcctgactcggtggctgagtcccaagcctgtaagcccaacgacacgaactgcaagtgggacctgtcattctttggttcgcagtcatcgtggtactacccggtctacgcgtccggtgagcggctcttccaaagcggtggcccggtaaacctgggcagctactccgacaagaaagccgacgagcttattgacgcgtccatgcgttcgaacgatcggacagccctcaaaacgtacaacgcctatctggctgaagacctgccggtgttatggatgccgaacccggtcaatcgcgtctcagcatggaaatccaacatccaaggaatcgatccacaggaccccatgctgtacctgtacccgcaggactggaccatcagatgacctcacgcagagtgagcccacgttactgaccccgcccgtttcacacggcgtcaccgggtcgccccggtgacgccaccccaacgtcccaatcacccatctcaggagggagcaaaggatgacgcgatacatcgcgcaacgcgtttttcaagcgctgatagtgctgttgctcgtcacgcttatcactttctccatccttcacgcacttccaggcggagcagctcgctcggctttgggactggacgccacccaagcgcagatcgacgcatacaaccatcagatgggttacgaccaacccttatggaagcagtacttcggctatctgatccagatcttccatggcgaattcggacactctttccgactcaacatgccggttgccgacgcgatcggtcagcggcttcctaagacgattgtcctcagtctcatgtcggcagtcgtcgccatcctcctcgcgatccctatcggcgctatccaagccgtcaagcgcaaccgcacggctgactacactctcaccgtcatcgccatgctggcatattccacaccattgttcttcctgggcctcgttctcatcatcctcttctcacaggtgtggccgatcttcccaccagaagcgccacaagggttcagcgtcggagaagttcttagccaagggcgatcgctcgtgctgcccaccacgacgctcgccatcgtcacgctggccgtgtacgcgcgctacatgcgttcctcgatgattgacaacctcgaggaaaactacatccgcaccgcccgcagtaagggaatcaccgagacaagagtcgtcatcgttcatgccctgcgcaactcgctgtttccgatcatcaccctactcggcatgcagttgccggccttgttctccggtgcgctggtagtggagtcgctgttcaactaccccggcatgggtctgttgttctggcaggcggcccagttccgcgactaccccatcctgctagcagtcaccatcatcatctcaatggccaccgtgctcggcgccctcatcgcagacatcctctatgccgtcgtcgatccgcggattcgttacggaggagcagaccgatgagcaccgagatcgctattcccgatcctcagagccgacgtcccgaatctgcccgtcccatgcgtcccggcacagcgcgacggaccagcagacgcaccagcctcttcaaacagggggtggaggtgttcttcgagaaccgtttggccgtcgtaggatttgtcaccctgcttatcatcgtcgttctgtgcttcatcggaccgtcgatctggcgcaccgatcaggtccacacccagctgtccagcgcttacctccccatctccggcacgcaccctcttggtacggacgcggtgggctacgaccagctcggacgactcatgctcggcggccagacatccatcatcgtcggcctggcagctggcatcctggccaccaccatcggaacgatttggggcgccacagccggattcgtcggaggatggttagacgctgcgatgatgcgaatcgttgactcactcatggctatcccggccttgttcctcttcatgctcatcgccacgctcgtcacaccgaccgtgcccttgttggtactcatcattggcgcatttgcttggctcaacccagctcggctcatccgcggtgagtcgctggctctgcgcagccgggaatacatcgtcgctatgcgtggcatgggcggtagctctctgcgcgccgtacgcactcacgttgtgcgtaatgccatcggcaccgtcatcgtcaatgcaaccttccaggtggcagacgccatcctctacgtcgcgtacctgtcatttctcggcctcggggttcccccaccagcggccaattggggcggcatgctttccgacgggctcgccgaggtctactcgggtcactggtggctgttatacccgcccggggtactcatcatcattctggttgtcgcgtttaacttcgtcggtgacggattacgggacgccttcgaggttcggctgaggagtagatgacatgagcatgtcacagcccgaagacatcttgctgcgtctgcaagatctggaggtcactattgacgtgcgcggtggcagggtcgcgcctttgcggggctgctccatggaagtacgacgcggcgagacgatcggtctagtcggcgagtccggatccggtaagacgatgacagcgctatccatcatgggcctgctcccccacggtggacgggttaccggaggatccatcgtcttcaacggcagggacctcactagttcgccacccgacgagacccggcgcattcgcggtatggacatcgggatgatcttccaagacccgctcacctcactcaacccgacgatgaaaatcggtaaccaagtaggcgaagcgctgagaatccacaaggtggcctcgaagaagaaggcttgggaacgctctatcgacctcctgcgcaaggtgggaatgccacgtccggaaaagatcgtcaatgactatccgcatcagctgtctggtggtatgcgtcagcgagtcatgatcgctatggcactcatctgctcacccagtcttctgatcgcggatgagccgacgacagctttggatgtaacgactcagcggcagatcctcgacctcattgacgacctcaagaaggagttcaacaccgccgtcatcctggtgacacacgatctgggagtagttgcgggccgggccgaccgggtagccgtcatgtatgcgggtcagatcgtcgaggtggcatcgtctaccgacattttcatcaacccccagcaccagtacacgcgctcgctcattgccgcactgcctgagcagaccaccgatacccgtgaggagctctacaccatccctgggatgccgccggacctgcgcgagaagatcgtcggctgcgccttcgctactcgttgcccgctggccactgagatctgcactcagtccaaccctcacatggtcaccctgggcagaaccgacgcgccaagtgccaacaacgaacccgccaaccatgtacatacctgcttccatccggcagggccgccgctgaagcgccgacacgacctacgcccggagcgagacctgtccagccaccccgttgtgtgctcagtgcaagatctccataaaaactaccctgccatgagcagcggcgtcatccggcgtcaaatcgggtgggtacgggccgtcagcggtgtcagctttgacgtctatgagggcgagacactggggatcgtcggtgaatccggttgtggtaaatcgaccttagggcgcgtcatcactgcgttggaaccagcgacctcaggctccgtgtgcatcaatggcaaggatattgctcaggcgtcacgcagggaacgcaccctcttgcaccgcaatgtacagatgatgtttcaggattcctacgccgcaatggatccgcgcatgcgagtagacgagatcctctccgagccccttagcatccaaaaaatcggagaccggcgttcgcgtgccgacgctgcggacaatctcatcgacaagatcgggctgtccgataacgccttgtcgaagtacccgcatcagttctctggtggccaattgcagcggatcggccttgcgcggtcactgatgctagaaccccatctcattgtctgtgatgagccagtcagtgccttggatgtatccgtccaggctcaagtgctcaatctcatgcgcaggctccagcaggagcagaacctcacctacatcttcatctcccacgacttgtctgtcgtcaggtacatgtcggatcgaattgccgtgatgtacttaggaaaaatcgtggaaataggtgaggctaacaaggtcgtcgaccacccacgtcacccgtatacgcgggcactgatcgaggcgatccccgttgctgaccccgcgcatcacgtggaggagatcgtgcgtctgcagggtgaaccagccagtgccatcgacacgcctccggggtgccgtttcaaaaatcgatgcccatttgccaccaacaagtgcgccgaagaacccccgttagtgggcgacactcaccgagtggcctgccacttccctctaccacacgacgtcttggaagtatcatgagccaccccggcgcctatcgaccggtcgtcgccatcgatattggcggcacaacgatgactattgccgaagtccgttccgacggaagcgtacgagatccggtgacaatggacagccccgcacgaatccatggcgacgaagtggtggcccgaatatgcgagcttgtcgagacccgctggccccatccgtgccggatcggcatagggaccgcaggagtcgtcgaccctatcagtggctcgatcggcagagcatccgactccttccaagggtggaccgggtacccactacgcgaacgtctggaagaggcccttggcgtggcggtccaagtggaaaacgacgtcaatgccttcctcgttggcgagcaacggttcggcgcagcggccggggagcgcgactgccttgggatcatgcttggtaccggtgtcggcggagccgtcatcctcgacggacaggtgattcatggtcggcgcggggccgcagccgaaatcggtcatatgcctgcgctaggaaacgatcgatgcagttgtggcgtccccggacacctcgagtcactcgctgggggaagggccatcgcccgacgctgggctgcggccactggacgggatcccaaatccgtcaatggcgcccgtgaggttgcccgccgggcggcaaacggcgatgctgtggcgccgcgaatactcgccgaagctggaaaagccctaggaatcgcactagtacaagccgcgaccctgtttgatctgagtacggtcatcgtcggaggaagcgtcgcaagggcatggcagtggctctcgcccggcctgcacgacgtcgtgacggcgtacccgttgatctccggggctgaattgcgggtgcgtcttgcctcgcttagcgaccgcgcggtcctcataggcgcagccagtcttggggtctgcgacgatcaatggacgaagccatgctgaacttcgacgaacgcaccggcccgaatcagggagtgaacgccccgcactggccgtcggtccaggtgcctcaatggtggaaagatgccaaactcggattcttcatccactggggcttgtactcggttcccgcctgggcgaccaccaatcccgacccggtaccacttgagcaggagtacgcccaccactgctacgccgagtggtatgcaaacacggtgcgcatcctcaactctcccactcgccgacatcacgacagggtatacgggatcggaacgagctatgaggacttcgccgactggtggagccccgacctagatgcacctgccacgctgatccgtcgaattgctgacgccggggccgggtacgtcatcccgacgacgaaacaccatgacggattctgtctgtggcataccgacacgaccggcttcaatgccgctaaacgaggaccgcaccaagatctcgtcaaggccttgcacgacgaggcgcgagcggcaggacttagattcggcgtctactattcgggagcgctcgactggcatgttggggacttcggggcgatcacctctgataccgagctgttcaccttccgccgcaacgaccccgacttcgccaaatactgcgccgctcaactcactgaacttatcgcacggttccgaccagacatattgtggaatgacattgagtggcccgatgcgggcaaggggagtcagccctacgggctcgccagcctgttcagccactacctgaagcaagtacctgagggggtcgtcaacgaccgctggggagtatcccaccacggattcctcactcgggagtaccgtcatgttgacgccaaaatcaacgaaccgtgggagtcgacgcgggggctcggacgttcttttggctacaaccaagaagagtcgacagacgagagccttagtggcaccgagctcgtccagtacctcgtggatgtcgtcgctaaaaacggaaatctgctcattaacgtcgggccacgcgctgacgggtctattcctgaggtgcaggccgctgcaatggccgaactcggacggtggatgagggtgcacgatgaagccattcggggtacccgaccctggggaaacggggtctacggtgaccagcgcatcgtcaagcgtggggaaactgtctacgtccatctgctcgacggggacgcgctccacctccctgacgagctccagggcttcgatgtcagctggatcggcagccagagcaagcagacctctgtgccatgcgagctcgttaaccagccggtcaaggtcgcgaggctcacccggtgaggatggatcccagtcatgtagtaaacaccgaccgcgataggacctcttagttgtgagggggatgggaccggcagagctatctcagtgaagcgattcccgggaggtcaccacacccggagcgcatcccgttcgtccatacgcagcggttgcagctttgagggcgtgtcctccgaggtccaatcgttgcgaccacgtacttatgcataaggtcg

SEQ ID NO: 75 - DNA, 18948 bp, Propionibacterium acnes
catcatgccgacgtcaaggatcggcgcggccatccaccggaggacacgctgaggcccgaatgatgagggccgtaggaatctcgactcttccgctgggttccgttccaagggcaagacgggccgcagtttctcccacggcagcgaaatcaagccgcaccgtcgtgagcgctggccgagtggccaccgaatggggatgatcatccatgccaacaaccgagacatcctcgggaaccctcaaccccaacctgtcaagaccagttaagaggccgagagccacatcgtcgtttccacataggactgcggtcacccggtgcgctcgtaccgcccgcgcaacgtgcatacccgtctcgaccgaccacccagtcgccaacggttcgagcggcgggagacctcgggtagccaggacttcgcgccatcccgcacatcgtggatcagggtgccctgcaggaggcactccgacgtaggcgatgcgacggtggcccaaatccgccaagtattcggtggccattaccgcaccggcatgatcgtcgatccacgcccgagaccagggttcacctccctcgggtctgcctccggcaatagcaaccgggagatcgacgggcaacccaggcaggagggccacgctgggggaatcaaattcgaggacgacaaccccgtcagctcgagcgtctaaggcacattgcatggtggaacggcatcgctccggcgaccccgccaatacatgtagggaggtctcgacaccgaggtcgagggctgcgctgagtacccccgaaagcgtcgcccagtagccggtgcggccgatgtcggagacgagaacatgcagccgggcaacgttggggtcggtgcgccaatatcccagctcggtggccgcggtgaggatctcctcggtggcctgtgggagggtaccttcagcgccattctgacgtgccaaggcacgcgacgccgttgccaaggagacgccggagcgctcggcgacgtcagccaaccgcggaggccaccagggccgcctcaccatggccgggtcacgttccatgcaccggacgataccgggttcacacccctgtcctcggcaagggcgtccgcggaagaccagggcgcgacggggccgcatccgcggctgctgaggtggagcgagctggggtggacggaacgggaatcgacgtcgccgatgggctaggaagaggcgaggggatcgtcgtggtaagcgtccagaccgctgccgtggccgaatccgagccctcgatcacccggctgtcagctacgacaatcggcaagccggtgaattttgagtgcagggtacgccccgccccatctgcaagcaggtgccagcgattgaggctgccctcagtatccgacgtcgtccgaagaccggacccgacgacgacctcgtgcttcccagcctcgacgtcgagaccgaggaccgcaccgccaggagtcgaaaggctgtaagtgcagtcgccgtgccgaaccacacaccaagtctgaggctgcgcctgcagagtagggacaccgtcgtgacatgccaagaatcgcccgtccgcgctagtcagccggtagtcgccggactccagtgccggattgggggcgtaccaagcgcgcacgtagtcgatgtcaaaactcgccgggagccgactgacgactggggtccccagatgcccctcaagactgagcaccatgtgccgcgacatccgccacagcgaagagtcgccaggtttcgtctcccaggccaggtgtcggtcacagtaaaatcggagtcgaccgtcgctgcgttcgacgccatacgtgtggtaatcccgcgagatgtcgacgccaaccgggtaggcgtggcctccgaagcgccggtgcgtggcctctgtgttatcgggccacacgtgggtcgcgatgttcatcttcgtgtggtcaaaagtctcctcgacgtcaagctccgggtttggctcggcgccggtaagcaaggaagggccaccgtcgagggcggacgactgcatccagatggccgacagcacccgggcggccgagggcaacaccttggcacgcacctcgacgtaggtgcaaagacccggcacgtcaaagactgactcaacagcgccaaacgtgtaggaaaaactatcgacttgctcggcacgagcagctacatggagttgcccgcctgagaaagacacattcgcgtctcgaaagaggccgcgtcccgagtgtgggtaccacaggccgcgatgccactgggccgagctgtaagtcggatcggtgaattcgtctccaacacccaggagggtccagccagcaaggtcgatatccgcgtcggcggcgatagcccgatcgtggtcggcaaccaccggaacggccgccgtgagaacggcggctccgaggactgatctacgtgtgatcagtgtcatgtgtgctcctttgcaacaactcactccctaactggggttccacgcagcctacgacgaatgaccgcggtcaccacgagcgcgtgaaaacggcctttcatgcgctgtggacggcccttttcccggctcctagggtgaacgacatcacgaacgacggccaatgccggccagccaggagttcaccaccatgcacgatgtcacccctgtcatccagccgtttcggctcacgacggcccccgaccaaccggtcggcttggcagccgggactcttgacggcgcggtgacgcttcccctcgtcgaatgcctcaccctcgaacacggccgatacttcgtcgaccatcgcctcacccagactacggtgggatccggtctgcgtcccgttcgccgcgaaccgctcacctcgccgtggcccggcacccgcgtcatccagcatgatccaggatccgacctcaccgtcaccgtcgatctgtggcatcccacctcagcgaccttgcacgggcgaacaaccgtacataatgacggcacgctcccagtccatctcactgccgtctctgtcatgtgcgccagtctgctgtctggagccgaactcgatgacctcgatatactcatcgcccccagcgcatggatggccgaacaacggtggacccatcaccgcctgtccgatcttctggtggacgtcggcaccgaattgcatggagaatccccgcgcgaccgcttcgtcctatcctcagagtccggttggtcttcaggacgctgggaaccagtcggcttcattaccgacccggcctctggacgcgccgtcggctggcagatcgagcacaacggtggctggactgtcgaattagcccggcgctcttcaaccctcgacctctgcctcttcgggccgaccgaccttcagcaccactggatgcaccagctcaaccctggcgagactttcactacccccacggtgacgttagtggtatccgataacagctggcagggcgcggcagccgaactaagcacctaccgccgtgcgttgaggggcaacaatggcacagcagctccgatcttcttcaacgactacatgaacaccctcatggccgaccctacggccgagcgactctcaaccctcatcccggccgcagctcgcaccggagccgaggtgtactgcatcgacgccggatggcactccgacgacacagactggtgggccgacgtcggtcgctgggagccctcgccccgccgatttcccggcggactgcgccacacccttgatctcatcgtcgcttacggcatgacgcccggcctgtggattgagccgctggcggtcggtctgcgcagtcctctcgtcaatgatctacccccggaggctttcatgcgccgcgcaggggttccgatcgtcgaacagaatcgggtgcgtctagatatgcgcaatccgcaagctcgcgctcacctcgataccgtcatcgaccggatggtcagttacggcatcggctacctcaagattgatgacaatttctctgtcggttctggccccgacgaggacgcggattctccgggggacggtttgctggagcactgccgcgcttgggccgcctggcttgccgacctccctcgacgtcaccctggacttgtcgtcgagaactgtgcatctggggggcatgaccaccgactacgccctgttggcccggacagccatccagtcgacatcagacctccaggattcggtgcgttacccgcccatcgccgccaattcaccgatgacgatgttgcccgaacaagccgccaattgggcttacccacaaccagacatggacgacgaggaaatcgtctttaccgtcacgacctccttggccggcaccttttacctgtccggtcatgtcgaccgcatgaacgcccaccagatggctctcgtgcaatccggcgtagaggtaaaggccttacgatcagatctgaccagccacataccgtggtggccgaaaggccttgccagctgggacgacgagtggatcgtcaccgggcgtcgaaaaaagtcctctcgcgacggggtgatcattgtctggcaccgtcctagcaccgaatcgacggttctcgacttacctgatctggctgggacccacctcgaacccctttacccacctgcctgtctggtccccgacccgggaattcacattgctgactcatcgagctcacctcggctgaattgtccgtctcccaaaccaaccggccgggtcttccgcgtccgggaccttcacgattgcgtcaccgatgtcgcagaaatggagaagaaatgaatcgcaccctcaaggccgccgcagtaggagccctcgcggcattgtgcctcactgcctgctccgacccaggctcagactcgtcgcaatcctcaggaccggagtcatggccgtcagcaaccaccaatctcaacggtgtggagttgacaatgtgggctgcccagtcgtcggcgtcaatccctcaacaggtcgccgcgaacttcaacaaggctaccggggccaagatcaagatcgtcacgatccccgacccctacgagcagagcgtccagaccaaagtcgccaccggtgacgtccctgacctggccatgtggcagccaacgacgtccatgctcacgagcctgggagccaaagagcatctgcaggtgctcgacgacgccccatgggagtcgaagactgacaaaaacgtcctggctgccggaggttctctcgacgggcaccgctacgccgccttcgtctcagccccctcggtcatgggcgtttggtacaacaaagaaattttcgccaagaacggtatccaggtaccgaagaatttcgacgagatgctcaccattgccaagaagctcaaggctgccggccagaccccgttctacgagatgggcggagagtggtgggcctcccagtgggcagtccaggtgcagctggccgacgccgctaaggccggtctgtgggacaaggtcaacaaggacgaggacaagttcaccggcgctgagatccaaggtgctatcaacacctacgacaccatgatcaaggacggtctgttcaattcggacatcgcaaccggaactttcaacgaccaagccaaggcgctgcttgacgggaaagcagcgatgaccattcaagtaacgagcctattgggcaacatggccgcccgagccgacaccgccactctcaacacgaagatcggattcttccccatctctaagtcgggcaccgtggcaacgtcgatacccgaccagaccaacgccgtggtcgccttcaagtcgaaggatgccaagagggagactgcagcacgtcagttcatcacctactggttatccaacgactacgcatccttcatcaaggcacaaaacaccgtttccatcattgatggtgttaaaacacccgattccgtgcccaaagccctcatcgactcgaacgccaccctcaaaggctcggtcggctcgatgcagtctctggctgtcgccaaccccgacttagctaagaacctcggtgacatgatcgctggcacgaagaccccagcacaggtgggctcagaaactcagtctcagttcgcccagctcgccaaggcgattggcgcgaaagggttctgatccgtatgtcctcgacggaagccgcgccgcgacacggcagtgcacaccagtcgcatccctggggattcgtcgtacccgcgttcgccgtgctcgcggtgttcttcctcacaccaacgatctacaacttcatctacgccttcaccgactggtcgagcttcaaaacgaccatcaacccggtgggatggagcaatttctccgatctcatcgcatcaggaagcctgcggaaatccttgattatcacccttatttatgcggctggcgttgccgcgttgcagaatctgttcggactgatgctggccatactgttagagcgcgacaccctcgtcaacaagatcgtccgggtgatcttttttatccctgtgatcctctcggcgctagcgactggttacatcttccaagcgttgctgcgccccgacggcgggctcaaccagatgctcggaatactcacaggatctccggtaaaagtctcctggctgggatcgacgacgtggactctgctcgtgtgcattgtcattcactcgtggaagtggatgggcatgtcgatgctcgtgtacctggccgggcttaagacgatcgatgcccaagtgctcaaagcggcacgcatcgacggggcgtcacggtgggcgaccttccaccagatccgcttgcctctcatcgccccagcggtgacgttcaacgtcgccaccgccttgctagggtcgatgaactccttcgatattgtccaggcgaccaccggcggaggccccggcggctccaccgaactgcttaacctcttcatcttccgaactttcggccagggtctctacgctcaggcgacgacgatgagcctggtgctcttcgtggccgtcgtcatcttggcattccccatgatcgggatgcttcgtcgccgtgagggaaggatgtcatgaccaaacgcatcattcagccacttggcgcggtactgctagccgtgctcgtcgtcgggatacccctgtggacggtcgtcgtcactgcaggaaagtcccaggccgaagcactcatcccggacatgtcattgccacaccactggcaactgtggaccaacgtctccactgtcaccagccagacaaggatcggctgggcatatctgggctcgttgttcctgctggtgccctcggtggtcgtcgtcttgatcatcggatcgatggcatcgtgggtattggctcgacgcaaaggcaagctcgtctccgtgatctacgcgctagggatttcgggcatcatcctgccgccagcggtcgtcaccttggtgttactgctgcgtcagctgggattggctggccgccccatcggaatgatctgtgcctatgtcgggatgtacctgtcgacggtgatcttcttcgtcactggattcgttcgcacgatacccgaatccctcgaagaagccgcccgaatcgatggagctggaccaatgcgcatctttgtgacggtcatcctccccctgctgcgaccagtactggcaactgcgacgattctcatcagcctgtacgtgtggaacgacgtcttctacgccttctttgtcgtaggggccggatggacaccttgccgctgaacttgtttacagtcgccagtgccggggtacacctcaataactggcatctcatcttcacctatgtgctgctcatgagcgtgccgatcgtggtgctgttcattgtgttccagcgcagcatcatttcaggcattacttcgggtgcggtcaagtaacccttcttaccgcctgggaccttcgatcggactggcgaaatctccacaacgctcaaccggtagtgacagtgaggtctggatcctgcatgtcctcgtcgaagggaaagatcggacgacgcagacggttatgacccagacgtataaggtcctggtccacaccgccaggggtgagcgccatgatccaatcggcggccaagtcgtaaaggtccggctcgagatacccgatcttcaccacgactatgtcggtcgtccgagggtccagttgtacccgctcaaactgttccagggtcgtgtactgattgcgccgagtagtcacgatgacgctaagccccccgactcccagcactgccgtacgcaggccgccaggatcgtcaacgaggcaacgcacctgggcactcaggtggacagggccaggcttgcgagtatcgacatgtccccctaaatccacctcaaccatgcccccgacgcccgctttgtcagcacgtttcacgacctgtgggtcatagatggaagcataaatcgcggagagctccccaccagtgatctcgggatgggtcaacaatacagatagcgcaatcgtcacgtcatcagcaccgccggcgcccggattgtcccccgagtcggaaataacgaacggtcgtcgcgatgacgccaccgccctgtctaccgcttcttcgatcccatcggtgggagcgacgaagacgaattcgcgacgcaccttccagaagaactgtgcaatctcgctcaccccgtcgcgtacgcggttctcgtcgtcaccgaacccgacgacggctgccgtgcagcggggctggtcggcccaagcaaagccgatccacaccccgacatcgataacaccgtcgtgagccgccacctcgggcaccatgccgtagagcgaagccgctggttcgagtctggtggacgtcttttcaccgggtaacagaatgggcacggtgaccatcgccttgatcggtttgcccttcccggaacgcagtcgctcgcacaatgtccgagctgccctctcccgtgacacccacgcatcctcgtgcggtgccatccgatagcaggtgagcaggtcgcagcccgcgaagagtttttcagagacgtttccgtgcaggtccatcgaagcgcccaccatcggctcgggaccaaccacgtcgcggatggcgctgatgagatctccctcaacgtcgtcgtaccccggcacgctcatggctccgtgaatgtcgaagaagatgccgtccacatgaccggccttcgccaggccgtcacagatttcggcgcgccacttctcgtaggtcagacgctccacgggtcctcccggcagggctgagcagtgcaggatcggtacccactcaacgtcatggttccatggacgttttgtcggcacatcccactcctcgcctgcgatagcccggggcacctggtctataccggggatcggggactcggtgatccacgggtatcgctccagcagtgtctggccgcgacgctgcgcgaagtcagcggccgtgctcatgtagggggtgaaagtactcgattcaatatgaagtccacaaatggctatccgtatcatcagcgattgccttcctgcgagatgggcatatgagagtcaagtatcgacatgccgatgagcggggcatcggctccgcaagcggaggtctcgataacgagatcctcggtgcacataggcaaacagcgctcgtacagttcactgcgtacgccagcgagcaaagaacccatctgcgacattgagccgcccaacacgatgcgaaccgggttgaggaagttaacaaggttggaaagcacctcaccaagacgcattccggcgtcacgcactaaggaaaccgcctggggatcgccgctgttctcggcagtcaccaactgtgaggttgtggaaatggacgagcccaaacggcccagctgccgtaggatcgcagcccccgatgccaccgtctccaaacatccggagttaccacaggtacacggtagggggttatcggtgtgcacccgcagatgggtgatgtcgccagcaagaccgcgtgagcctgggtaagcgaccccgccgctgacccaaccagcacctatgccggtaccagctttgacgtagatgcaggagtcccggtgccgtccgcgacagttccactccccgattgtcgcggcacgagcgtcattctcgataactgatggcaccgcgagttcctgtgtcaacatgcctgcgatgtctttgccactccacccaggcatccgcgctgccccaatgacgtgaccactaccgtccaccgggccgggtaccgccaaaccggctgaaaccaccgctccagggatctcgtcaccaagcttgtgccaccccttggccaaggctttgatcgtcttctccggaccgatctctatgtttatcttgatgtcgtcggtagcgagtagctcgccctcccgagacgctattgccaaccgggcatgatgctggccaagttctgcaacaaaggcattgccgactgctggtgcaacgcgcaatttagtgggacgacgaccaccggtggaatcggcgcacgcatactcttcaacgactcgcgactcgagcaggtgccgcaccgccgcgctcaccgtggaacgtggcatggacgtgctctcggcgatctcggcgcgagtcatacccggcgtttttcgaagaatcttgatgactcgctgcccaggagcgctgcccagctgatcgtcagtgtgcccattcatgcccgtcgcgccaaggttggtgagctcaatatctgtcatcagcttcctcaatccgtcatcgtgcctgcccgacgtctcggcccacagtatgcccgcgtccggagatgtgtgtagcaaaagtgataaaagctagattattttacattcgaagcatccgaagtcatcaccttgcgctactcttacggtagtaagggtttatcccaccaggcaacggaggctgagagaactcatgaagaaaccacgaaagagactgcttgtggtgaccgcagcggtggcagcaactctgttggttgcctcgtgctcgtatggcagtggcgaccccagtcggtctaagacaagcggcggcgcgcacgatggcaacgtatccttcgcgaccaccacgcccaactggatcctcccggtgtccgcacccggaaagacgcagggtgagaacgccatgttcacccagctcatctaccccgccttgttctcctacaagctcgacgcgaagaacgagttcaacatcgatgaacgccactcggtggccaaacccccaccgtatccgacgactcactcacctacaccatcacccttaaggaccgcacatggagcgacggcgtcaagctcactacgcgcgacatggagttctggtggaacatcgtcaccaacaacaccgacaagtgggcgtcctaccgcaaaggccagttccccgacaacgtcaaggctttcaagatcattgacgacaaagccttcaccatcaccacgactgagaagtacaacccggcatggttcatcaacaaccaactgaaccgccttgtgccaatgccagcccacgcctggtctaagaccagcgactccgacaagcccggtgagaaggaccgcacccctgccggagccaaggcaatcttcaaatacttgagcgccgcctcggagaacttacagaactacgacaccaacaagctctggaagacgactctcgggcccttccagctcggcaagtacaccccgaacggtgaggccaagctcgtcgccaatcctagctacgacggtgaagacaaggcgagcatttcgagcttcaccatgcagccgtacaccagtgacgacgctgagttcaacatcctgcgctccggaagcatcgactacggcttcatcccacccaactcgatgacccagcaaaagtacatcgagaaacagggctataccgtcaaaccgtggtacggctggtcgatcacctacatgccgtttaacttcaacaacccgaagtccggcccgatattcgcccaaaaatatatccgtcaggcgatgcaacacctcattgatcaggaaggaatctccaagatcatctggaaccggactgcatcccccacctgcggtccggtaccccagcaacctggcaccgccggtagctccaaaggttgcgcctacgactacaaccctgcgaaagctgagaaactcctcaaagaccacggttgggatatcactaaggacggagtcaccacctgtcaacaagccggggagggagaaggccaatgcggcaaaggaatcaagcagggggccaagctttccttcaccgtgatctcccaatccggtttcacctcgaccacccacatgttcgccgaactcaagtcgagtttttccaacgtcggtatcaacttggagatccgagaggttcctgactcggtggctgagtcccaagcctgtaagcccaacgacacgaactgcacgtgggacctgtcattcttcggttcgcagtcatcgtggtactacccggtctacgcgtccggtgagcggctcttccaaagcggtggcccggtaaacctgggcagctactccgacaagaaagccgacgagcttattgacgcgtccatgcgttcgaacgatcgggcagccctcaaaacgtacaacgactatctggctgaagacctaccggtgttatggatgccgaactcggtcaatcgcgtctcagcatggaaatccaacatccaaggaatcgatccacaggaccccatgctttacctgtacccgcaggactggaccatcacatgacctcacgcagggtgaagccacgttactgatcccgcccatttcacacggcgtcactgggcgccccggtgacgccaccccaacgtcccaatcacccatctacaggagggagcaaaggatgacgcgatacatcgcgcaacgcgtttttcaggcgctgatagtgctgttgctcgtcacgcttatcactttctccatccttcacgcacttccaggcggagcagctcgctcggctttgggactggacgccacccaagcgcagatcgacgcatacaaccaccagatgggttacgaccaacccttatggaagcagtacttcggctatctgatccagatcttccatggcgaattcggacactctttccgactcaacatgccggttgccgacgcaatcggtcagcggcttcccaagacgattgtcctcagtctcatgtcggcagtcctcgccatcctcctcgcgatccctatcggcgctatccaagccgtcaagcgcaaccgcacggctgactacgctctcaccgtcatcgccatgctggcatattccacaccattgttcttcctgggcctcgttctcatcatcctcttctcacaggtgtggccgatcttcccgccagaagcgccacaaggattcagcgtcggagaagttcttagccaagggcgatcgctcgtgctgcccaccacgacgctcgccatcgtcacgctggccgtgtacgcgcgccacatgcgttcctcaatgattgacaacctcgaggaaaactacatccgcaccgcccgcagtaaaggaatcaccgagacaagagtcgtcatcgttcatgccctgcgcaactcgctgtttccgatcatcaccctactcggcatgcagttgccggccttgttctccggtgcgctggtagtggagtcgctgttcaactaccccggcatgggtctgctgttctggcaggcagcccagttccgcgactaccccatcctgctagcagtcaccatcatcatctcaatggccaccgtgctcagcgccctcatcgcagacatcctctatgccgtcgtcgatccgcggattcgttacggaggagcagaccgatgagcaccgagatcgctattcccgatcctcagagccgacgtcccgaatctgcccgtcccatgcgtcccggcacagcgcgacggaccagcctcttcaaacaggggtggaggtgttcttcgagaaccgtttggccgtcgtaggatttgtcaccctgcttatcatcgtcattttgtgcttcatcggaccgtcgatctggcgcaccgatcaggtccacacccagctgtccagtgcttacctacccatctccggaacgcaccctcttggtacggacgcggtgggctacgaccagctcggacgactcatgctcggcggccagacatccatcatcgtcggcctggcagctggcatcctggccaccaccatcggaacgatttggggcgccacagccggattcgtcggaggatggttggacgctgcgatgatgcgaatcgtcgactcactcatggctatcccggccttgttccttttcatgctcatcgccacactcgtcacaccaaccgtgcccttgttggtactcatcattggcgcattcgcttggctcaacccagctcggctcatccacggtgagtcgctggctctgcgcagccgggagtacatcgtcgctatgcgtggcatgggcggtagctcgctgcgcgctgtacgcactcacgttgtgcgtaatgccatcggcaccgtcatcgtcaatgcaacttttcaggtggcagacgccatcctctacgtcgcgtacctgtcatttctcggcctcggggttcccccaccagcggccaactggggcggcatgctttccgacgggctcgccgaggtctactcgggtcactggtggctgctatacccgcccggggtactcatcatcattctggttgtcgcgtttaacttcgtcggtgacggattgcgggacgccttcgaagttcggctgaggagtagatgacatgagcgtgtcacagcccgaagatatcttgctgcgtctgcaggatctggaggtcactattgacgtgcgcggtggcagggtcacgcctttgcggggctgctccatggaagtacgacgcggcgagacgatcggtctagtcggcgagtccggatccggtaagacgatgacagcgctatccatcatgggcctgctcccccacggtggtcgggttaccggaggatccatcgtcttcaacggcagggacctcactagttcgccacccgacgagacccggcgcattcgcggtatggacatcgggatgatcttccaagacccgctcacctcactcaatccgacgatgaaaatcggtaaccaagtgggcgaagcgctgagaatccacaaggtggcctcgaagaagaaggcttgggaacgctctatcgacctcctgcgcaaggtgggaatgccacgtccggaaaagatcgtcaatgactatccgcatcagctgtccggtggtatgcgtcagcgagtcatgatcgctatggcactcatctgctcacccagtcttctgatcgcggatgagccgacgacagctttggacgtgacgactcagcggcagatcctcgacctcattgacgacctcaaaaaggagttcaacaccgccgttatcctggtgacacacgatctgggagtggttgcgggccgggccgaccgggtagccgtcatgtatgcgggtcagatcgtcgaggtggcatcgtctaccgacattttcatcaacccccagcaccagtacacgcgctcgctcattgccgcactgcctgagcagaccaccgatacccgtgaggagctctacaccatcccggggatgccgccggatctgcgcgagaagatcgtcggctgcgccttcgctactcgttgcccactggccactgagatctgcactcagtccagccctcacatggtcaccctgggcagaaccgacgcgccgagcgccaacaacgaacccgccaaccatgtacatacctgcttccatccggcagggccgccgctgaagcgccgacacgacctacgcccggagcgagacctgtccagccaccccgttgtgtgctcagtgcaagatctccacaaaaactaccctgccatgagcagcggcgtcatccggcgtcaaatcgggtgggtacgggccgtcagcggtgtcagctttgacgtctatgagggcgagacactgggaatcgtcggtgaatccggttgtggtaaatcgaccctaaggcgcgtcatcactgcgttggaaccagcaacctcaggctccgtgtgcatcaatggcaaggatattgctcaggcgtcacgcagggaacgcaccctcttgcaccgcaatgtacagatgatgtttcaggattcctacgccgcaatggatccgcgcatgcgagtagacgagatcctctccgagccccttagcatccaaaaaatcggagaccggcgttcgcgtgccgacgctgcggacaatctcatcgacaagatcgggctgtccgataacgccttgtcgaagtacccgcaccagttctccggtggccaattgcagcggatcggccttgcgaggtcgctgatgctagaaccccatctcattgtctgtgatgagccagtcagtgccttggatgtatctgtccaggctcaagtgctcaatctcatgtgcaggctccagcaggagcagaacctcacctacatcttcatctcccacgacttgtctgtcgtcaggtacatgtcggatcgaattgccgtgatgtatttaggaaaaatcgtggaaataggtgaggctaacaaggtcgtcgaccacccacgtcacccgtatacgcgggcactgatcgaggcgatccccgttgctgaccccgcgcatcacgtggaggagattgtgcgtctgcagggtgaaccagccagtgccatcgacacgcctccggggtgccgtttcaaaaatcggtgcccatttgccaccaacaagtgtgccgaagaacccccgttagtgggcgacacacaccgagtggcctgccacttcccactcccgcacgacgccttggaagcatcatgagccaccccggcacctatcgaccggtcgtcgccatcgatattggcggcacaacgatgactattgccgaagtccgttccgacggaagtgtgcgagatccggtgacaatggacagccccgcacgaatccatggcgacgaagtggtggctcgaatatgcgagcttgtcgagacccgctggccccatccgtgccggatcggcgtagggaccgcaggagtcgtcgaccctatcagtggctccatcggcagagcatccgactccttccaagggtggaccgggtacccactacgcgaacgtctggaagaggcccttggcgtgacggtccaagtggaaaacgacgtcaacgctttcctcgttggcgagcaacggttcggcgcagcggccggggagcgcgattgccttgggatcatgcttggtaccggtgtcggcggagccgtcatcctcgacggacaggtgatccatggtcggcgcggggccgcggccgaaatcggtcatatgcctgcgctaggaaacgatcgatgcagttgtggcgtccccggacacctcgagtcactcgctgagggaagggccatcgcccgacgctgggctgcggccactggacgggatcccacatccgtcaatggcgcccgtgaggttgcccgccgggcggcgaacggcgatgctgtggcgcgcgaatactcgccgaagctggaaaagccctaggaatcgcactagtacaagccgcgaccctgtttgatctgagtacggtcatcgtcggaggaagcgtcgcaagggcatggcagtggctctcgcccggcctgcacgacgtcgtgacggcgtacccgttgatctccggggctgaattgcgggtgcgttttgcctcgcttagcgaccgcgcggtcctcataggcgcagccaatcttggggcctgcgacgatcaatgaaagaagccatgctgaacttcgacgaacgcaccggcccgaatcagggagtgaacgccccgcactggccgtcgacccgggtgcctcaatggtggaaagatgccaaactcggattcttcacccactggggcttgtactcggttcccgcctgggcgaccaccaatcccgacccggtgccacttgagcaggagtacgcccaccactgctacgccgagtggtacgcaaacacggtgcgcatcctcgactcccccacccgccaacatcacgacagggtatacgggatcggaacgagctatgaggacttcgccgactggtggacccccgacctagatgcacctgccacgctgatccgtcgaattgctgacgctggggccgggtacgtcattccgacgacgaaacaccatgacggattctgtctgtgggataccgacacgaccggcttcaatgccgctaaacgaggaccgcaccgagatctcgtcaaggccttgcacgacgaggcgcgagcggcaggacttagattcggcgtttactattcgggagcgctcgactggcatgttggggacttcggggcgatcacctccgataccgagctgttcaccttccgccgcaacgaccccgacttcgccaaatactgcgccgctcaactcactgaacttatcgcacggttccgaccggacatattgtggaatgacattgagtggcccgatgcgggcaaagggcgtcaaccctacgggctcgccagcctgttcagctactacctgaagcaagtacctgagggggtcgtcaacgaccgctggggagtatcccaccacggattcctcactcgggagtaccgtcacgttgacgccaaaatcaacgagccgtgggagtcgacgcgggggctcggatgttcttttggctacaaccaagaagagtcgacagacgagagccttagtggcactgaactcgtccggtacctcgtggatgtcgtcgctaaaaacggaaatctgctcattaacgtcgggccacgcgctgacggctctattcctgaggtgcaggccgccgcaatggctgaactcgggcggtggatgagggtgcacggtgaagccattcggggtacccgaccctggggacacggggtctacggtgaccagcgcatcgtcaagcgtggggaaactgtctacgtccatctgctcgacggggacgcgctccacctccctgacgagctcaaggtcttcgatgtcagctggatcggcagccaaagcaagcagacctctgtgccatgcgagctcgttaaccagccggttaaggtcgcgaggctcacccggtgaggatggatcctagtcatgtggtgaacaccgaccgcgataggacctctacgcgataggacctctagttgtgaggggatggaccggcagagctacctcggtgaagcgattcccgggaggtcaccacgcccggagcgcatcccgttcgttcacacgcagcagttacagttttgagggcgtgtcttccgaggtccagccgctgcgaccacgtacttatgcataaggtcg

SEQ ID NO: 76 - DNA, 13940 bp, Propionibacterium acnes
agcaagcacggcaccaaccgggtgatctttcagttgtgccacggcttgacgatgcttctcgtcgagacggacggcttcggtagcctgcaacgcaccgagcacaacccgctgggacgccttgccccacgcctcgaacacctcgtgtgcagcctccgggtccaccgcgatgttccattcacttgtcggcccggtattgccacgataattgatcgccccacccatgacgtgcagcccccgcaacaaccgcggcaattccggttcttcccgcagcgccagcgcgaggttcgtcaacggcccggtgacgatacccaccaacttccccgggtattggcgcgcgagatcaacccacagttgtgccccgctacgcgaatccgggtgacgcccgcactcccctagcacagcgtgccccaacccgtgcggcccgtgggtctcctcggcggtcatgagaggctcgacgagcggaacgtccgcccctcgggcaaccggcacgcccattccgagcagatcagtcaccccaagcgcgtttcgcagtacgtcgtcctgccccacgttgccggcagtcgtcaccaccccgacggtctcaacgtcgtcacggcaggccacgtaggccagggcgaaggcgtcgtcgatacccggatcgcagtccaacaagacgggcagggagcgcgtagaagtcgacatgtcgccacactaaggcttcgaccgttgtggcgtcaccctccgatgcgtccaccaaacttgtagcgggattcatgaagaagcgccgcggaacagaccgtgctccatccccgcgatgatgaactcaattttgagatcgagattcccgcgctcccccatgtcctgcattccgaatagttcgggtagctctccagcgatcctcacaaacttgtccaatccggtgcgaccttcttcatcacaggtcatgtacggctggaccgacatgtacgtctccaaggccgtgtcccccgcgaagtccagggcgaaggctgccccttccttgcccccggggataccgagtgcggccaacctctcaacgatcgccgtgattcgcggtagagctactccgaaggcttcaggccgggtgacaataacggcggccgcctccggatagcggacacacatctgccactgccgatccacgacatcgcgcagcacgtcctgccaggtgcacaactgcggatccggttcgatgtcggcagctatcgcgctgatcgcggcaagctgcaactcctgacgggaactgaactcccggtacaaggcagtggccttcaccccaaggcgctcggcaaccgctcgaagagtgaaactgccaattccttcagctagggtagcgtcaatgacctgacgtcgtgtgaacgcaggtttacgccccggccgttttctcatcacggccgacccacgagcgaccaccccacagcccgttcccgggcatgccacagatcggcatacaggccgctgctggcaatgaggtcgtcatgggttcccacttgacaaaccctaccagtgcgatcgacgacgactatctgatccgccgaacgaatggtgtcgagcttgtgggcgataacgacgattgtcgacgtctgccgcagctgggtcacagcggcctcgacatgggcctcgttctccgggtccaaagccgaggtggcctcgtcgaaaagcagaatcggggcgcgtttgagcaaggcccgagctaccgacacccgctgacgttcgccacccgaaagccgacgacccccttctccgacgctggcatcccaaccgcccggaagacgatcagcaatctcgtcgacaccggccagggctccggcctgacgcacgtgctcatcggtggcgtccgggcaaccgatgcggatattttccgtcagggtggagtcatagaggtacacatcctgaaacaccatggcaagctgactcatgagctgctcagtagtctgatcgcggacatcgaccccaccaactcgcaccgttccggaatcagcatcccagaacctggcaatgagccgaaacagagtggacttgccagcgcccgagggtccgacgatagccgtcaatccgccggccggaacagtgaacgagacgtcgtggaggaccgggcgagcctggtcgtagccgagaggatctcgtcgacctcggcgaccggttcacgcgcagtctcgacggccagggtcgcagcaccgacattctccaacaccttcgtgtagcgcagcgaaaccccgacgaaagccaccgccacgaccgggttcaacgccccgatccgcccaggttcgcggcgagcacgatgagggtcacggcaatgccctgggccgtcaacccgaagacgaagctcgccaacactcctagccacagatccttgcgggcagcacgtctgctggccacctgggcatcatggagaggttgatagccggtggcacgtccagctgcccgcagtgcaggttgagattcacagaactcgactattcgggccgccaattcctgctccgtggggtacgtcaacgcttcaccgcgaagtttgagggcgcgtgaggcgatcgtgaggaggtacatggtcggaatggcaaggagcagggccaaccccaactgccatgaccacatccagcccaggaccatcatgacgagggtagtggtcatgcccttcaccagcggagcggtgaagtgtcccaagcactcgcctagcgtcatgagtccacgcgtcaacaggcgcgagagacgggcgggaaaactcggccgaaaccaccccagcggcaggctggcgacgtgatcaccgatacgggtactgaggtgactcaggatgtctatcgcgcatagataccccgtgctcgactgaaggtacgacaccacagccccggcagcggccagagcagcgagcacccacacccagccccaccaggcaaggcccaacgagggctgccccgcaacgaaagcggtgaacgtcgggatgacggcaaacaggccgactccctcgatcgctcccagcacaccggcccacaccaaggaactgtgcaaccgccgggtgccctcgttggtcaacaatggttggaacgcccgcaccaggaggatgtccccgacccaagaaagacgtgacgacgtggtgctcatcgggtgactccctccatgattcgtcccgccgacagccgcgcccagtagggctgttcggccagttgctcggcggtgccgcaggctgcgatagagccgttctccatgacgcagatgacatcagccccaatcaccgactcggcgtgatgaccgatgaccaacacggttcggcctcgagccaaagcggccagggcctgctggatctcggcctcgcagtctggatcggtggccgcagtcgcctcgtccaggacgagaatcggggcatcggccaacacggcccgcgcaatggacaggcgctgcttctgcccacctgacaagttggtgtcctcacccaggacggtgtcgaaaccggcgggcagggcatcaatgtcgtcgaggattcgggccgtgcgggcggcattgcgaacttgttcttcggtggcatcggggcgagccagggtaatgacgtcacggatggattgacgctgcaagtatgggtcctgcaagacgaaggagacgagtcggtaaaggtcggtcggggagagctccctgaggtccaccccaccgatgcgcaccgtgccgaaatcaggatcgcggaatcgggccaacatcgtcgcgagggtcgacttgcccgacccagacgggcccacgagggccgtgacagtgcccgggcgcagtgtcagagagacgtggttgagggccggaacctcgccgtcaggggtgtggtaggagacgctgatgtcgtcaaaggtgaccgtcgtgtcctcgggaatcgcggagctggtaccaggctcgtcgatctgctcgatagacaggacctcctgcagacgcaacgctgcaccaccagcttgctggtacatccacgccgtgcttccaagcacctcgacggtgcgcggcagcacgagggcgataagggagcaggtgagaacatcggcgacacccacccaaccggccctggccatgagtagaccgaagccgaggttgatcgccatgagcgcaggcaccgagatcaccgactgcgatagggcggacgccttgatgagcgggccgcaccagtcccagtaaaaccgggcgaactcctcgcaggcagtggtgaagcgtcggtgggccttgcctgtctgaccgaagttcttgacgacgtggatgccctcggtcaactcgatggcgttggccgagatgttggcaagtttgtcgttcatctcggcggtcttggcggtcatgccccgcatcgaccaccactgcaacagggcatagatcgggaaagtcgccagacagagcagacccagccgccaatccactacgaaggcgtagacgagcagtaccacggggatgccgatcgccgcggtctgctccaccggggcgtgggcgacaagtgcatgcacctggacggtgtcgtcctggatggccttacgcacctgcccggtggacgacgaactgaaccatgccagcggtgcccgggacaggcgcccgatgatgcgaccctgcaggacactgcgcagtttgaggtcagcgaaatgtgtgatgacaacggctagcacgtagagcagggcctgggtgcagaaggccgccaccaacaggttcgcggtatgtacgagggcctcgtggtcgatatgggcgctcagcaggatggtgccgagcttcaccaaggccagatagggggccaaggcgacgacgcaggaggcgatgacgataatccgcgccgccaggattcgtccccggaccggttgcataagcgatgagagggctctacccccggcgcggtgcttggcctgatagtcgtgggaactttcggcagatgcagtttcctgggctgccacggaggctggaggcgacggttgggacgggccaacgatggaggcaggatcccccgaggtggttctgctcacttcgtcagtcccgcccgccggaagtgtttgcgccccaccttgatgcccagccaaccaccgagaagtccaagcaggaacaccgcgacggcccatccggcgaccagaccgggggtaaacagtgctcgcatcttgttggaataatcggcacccatttgcttggtgatcatggcgtagtacttgtcggcgttcacgaccatcggtatcagtggcgcaaccacccaaagggtgaataccgcatagccgagggacgcccggcgcgggtccaggcgaacgttacgcccggcgttggtggtgaccagatcggcgatgaagccgagcacgagcccggcgggaatcatccagatagtgtgcccgggcatcataccgagtccgacgagcagcccggtgatcgtcaaagcgcccattttcgggacccgtgccattgacagcatcacgatgatcccgcccagcagaataccgaggatccagccaacgaacatgaacgccggcccggcgaaaccaatcatcccgcaggcgtagaaggcgacgaagaaaatcaccgcgaaaatggctacggtcaccagatcacgagtggtcaggcgtgatttcatgatttccctttcaaggtggcgatattgaccagaaagtccccgcaccgggccatgagctccgggtcgtgggtgatgacgatgacaaccttcccggcggtggcaagttcaccgacgagatcggcgatcgacgcgagatgtcggcgatcgacacctgaggtcggttcgtcgaaaatgacgacctccttgtcttgcgcgatggtggccgcgacgacgaggcgttgcgcctgcccacccgacaaggacaaggggtggcggtcatgttcgccagccaggtcgagacgtttcagaagtcccgatacgtcggcggcatctcgatgcggaagatccagtccgagggtgacttcacgttctaccgactcgctgaaaagctgacggcgaacgtcctgcatcaccatcccgcaacatttctgacgcctgccgggggtccagggcactcccatgacgatgcgagcttcggtaggggatttttcgagcccgcacacgattcgggccaaggtcgacttccccgcgccattcgggccggtcagaatcgtcaccgccccgccaggcaggaacagggaatcgatgtcgagaatcgtcgagccgggacggtaagagaaggcgaggtgctcgatggtcagccctgccgggatttttgtgcagccggctgaggcgggatcggagcgcatgaacttgcctcggggcaccggagtaagcggagccggagcctgcggcggcgccggcaggtcgaccgggttgacgtcgagactgcgcaagccccgttctagcaagtccccctctgtcagcgcgaaaaggctgctgccgctcattcgctcaacgatctggccattggaaacacgatgcacgtcgtcaacaagtccgcggaacagatgcagccggtgctcagcgatcacaagggtcttgttggcagctttgagctcggtgacgagagcgcgaaaatcgtcgatcccctcagccgagaggttcaaggtcggctcatcgaaaagaagcaggtcgacatcagccaccagcgcgcaggcgcaggcgacccgctggagttctcctcctgaaagggtgtcgaggtggcggtcgagcaggtgagagataccggttcgggaaaccgcacgggagacagcttcgcggatgtcaaccggatcgaccccatagttctccagcccgaaggccagctctgtgcgcacgctggaggtgaagaactgggtacggggattctggaaaatcaccgcggaggtgcggccgacatcgtgcagttcgacaccggccaggtcagtaccttggaccatgacgtggccgcgcaacgttcccccgaagaattgggggacgagtccattcatcgtccgcaatagggtggatttccctgaccccgacgctcctactagcaaggtgagggtgcctggttggatcgtcatcgtgatgccacgaagctgttctacgaactcccgctcgggggccggaccgtcggagaacggcgaggagtcggggtcgaacgaggggtagccgtagctgacgccgttgaggctgacgatgctcacacaatcacctcgctaacacgccacacaaccaacgcggccaaaatcgtcagcacgagggcgtcgccgacacgaaaacgactcggctgggtgttcgatcgggatttttgtgcaccgagtcccttgatgatggcggctgcggaaagttcgtcggcgatgcgggcagccgaggccaggaagggaatgacgacgtactctcccgtacgtatcgggtgacgcacagccgaccgcgccccagggttgaggccgcgcagggtcatggcctggacgattgctcgcagctcgcgtactgccatcgggaagaaccgaaccaccaccatgacgggcacataaatgacgcgcggagcatgcaattgggtgaggaccgcgccgactcgagtgacgtcgaggactttgatcgccgctactgccgcaccaaagactccggcgaaccgaaacatccagaaggcgatgaagaccaggaacgccgatactgtcgagcgccacagcactgggagtaggaagcagcagaaaatccacaccagcacgaagatcgtccagctgatccaggacttcgaccgggtagtcaagaccaagaacacccacaccactccaagactggtcatcacgagggctgttgatcctgctcccatgagtaggacgttgagaacgatgacgtagagggcgagggtgcgtggatccaccgcgccgaagagctgccgagatcggcgagtgtggaacgccgaagcagcatcgaaacctatcccggcaaccgagcgactatggggaacgcggtgagtggctccgggcagcgccagggtcgcctcatcatgtttcataaggtaaccctatctcataactgattgctgttaacaaataccttctctcccacgttgacccagagttggccatgatggcgccatatgagctccctgccaccacgtgaggcacgatggaggggccgacgaccagttaccgaagaacaggtgtgagcatgactgacgtggagaagtccccgactcgcggtgagaggattctcgccgctgtggtcgccttcaccctctggatggccgtgatattcgcgattgtggcgatcttcgtcggctggcggtggtctctgcggatgttcgtcggggtgctcctcatcggtatccccggagagatcgttatggagctcgtcggtcggggaccgttgctgccgagcggcgcgtcgagaatacggcgttcccgtggttcgcggttactcctctcggcactcatccttatcgtgtgggcgttcatcgttctcgcggcgattgcgctcattcagccctggtacggcgctaccggtgacatggcctgggtgatggtcgtagggatcgcggcgatcctcgtgcaggagggcaccgacacccgcaagaagaagtcctgatcatctctcatgaagggcttgtcggctcctcgcatacaagggggtcgatagtggtggccggaacgtgcgggtttgatctcgccacaatcatggataccgccagctttggtgtccgtccctgccacaaagcatcacaaaagcatcggtttacacgtcagcatcgctgctgcggttgatcgtgaggccacctgagaccattcagggcaggctcacccattcccttccgatttacacctcgtgcgaactcgcaccgcctacaattccagagcaacgacgcctcatccccgtcgccatagtcaggaaaacactgatgatgcccagggtccgcccgtgacgaagaagagctccctcgtcctggcgatggcgtccatcggtgccatcgctgttgggctgaccgggcgtgctcgtcagctcaccctcgccttcaactccgcgagttggctcgtcgccgtcatcgcgctgagctatctcatccgctccgggcacagcgaaaaaacagcatggctggcccaaccaccgagggtgcccgaggcacagccgccaggcggttgacggtctcctcgacgtgcattctcacaccatcgcacggcgaacatccaccgatccgctgcccaagcacggctaccctggaactcagttgagtgagaggagacccgcgtgggcatcggaagcaacatcggcaaggcactgttggcccaagcccccgacatggcacccggcgcagctgtctcactactacgcagcatcctcggattcgctatcgacggcgcctcagggctgccgggagcgcgtcaggctgccggcaagacgctcaccaagcacgagggcgatattgagcaggcgatcagctccttagtcaatcagcacattgcgatggccggggcccaggggttcgtctccaacctcggtggcgtcgtcactctggccgtgactatccccgccaatatctccggcgttgcgatcgtgcaagcccgcatggtggctgccatcgcccacctgcgcgggtacgatctcgacgaccagcgggtccgcaccgccatcctcgccactctcatgggtcagcgcgaggtcgatagcctcgtccacgaggagaagctaccgacgacaccgatgggcatcgctaccgctccagtcggtgacgccgatctcgaaaaggtcgtcgcccggaacctcgtcaatgtccttatggggcaggtcgcaggtaagaagctgcctgtgttcgtctccaagcgcgttcctgtacttggcggcggagtcggtgccaccgctgacggattcaccacgtggagcgtggcccgctacgcccgtaagcaattccccacccgccgtccacgcacctgagacccgcacactcgggatacggccaggacgattcgggggcaggaatagtggcgtccgaccacagtgacaggatctggccgggattcaacgacgcagggatttcaccccgcccagcccccatgcgtacccgacaacacctaggaaggcacaaacgacggcacacaccatggccatggtagacactgtcggcgcactcccctcgacggcggccgtttttcctggatagccgccggggaggaatcgcaggagggtcttcgactgtgcgacgaccacaaccaggtagatcaggggaccgcacaatggcccgactcgccgtgacaccattcccgtgacgaacaatgcgataccggtacacagcacgcaagtcaccgagaaccctatgaatggcggccacggcagctgaaaccgtgcgggaatttgcggtaccaggacggaatcaccatcaggtatcaactcaacgggcaacgatcgcagtacccatcctatgagcaatggaagaccagctgcacagccgcatatccacagccccatccacgcatatccaaccgtgagggaccgaaccgatgtcctctcgacccaatccatggccgatgagacacaccacatgatggtggcacaacccaccagaatgatcagctcgggaccagtcacagggcgatcccacacgtctctcggcgccaccgacagactcgccttccacaggaagaaggccacgagcaaggccacaagcggcgcaatgacaagggcactagcatggcgccccttcaggaaagtcgctacgcctctcatcggtgaagatcactggaggtcaatgaacacgtgcttaccgcatgatgatgctccgtataccaatgacggaatgcggttacatccatgccgtcaaggccatttcgttccgaactcgtcgcatcatcatgctgaaatccagccagccgaagaatggtacgttccacggaatcgacgccattgagggcccccatctgctgagatgtcaactccgaccctccggtctcacgcataaaagcacatgcgtcccggcctgaaaatgattgagccagcccctcacccgtcagatccgacatttgttgtctagagccatgtgaggtcggtcggccgagatcaatcacacgttgccccctgtatgtttggtacccagactcagcaagcaggacgtcacgggaaaccaccgtttgcggcaggacagacaagacgcgttgagcgggtttcgcgtaggacgccgcgagactccgatgtgctggcgtgacgcatacccgcacaccttcgtgcgacgaacactcaaaggctagtggcgcatcacgaaacaacggcaccggcaagacgacgcccacggcagcaatgatgagcggtggggcgatcaaggccacacaaggcatcactcgacgccagcagaacctgtcggcacggaccctggaccaacggctggcggtgaggatacaggacaaggtgacgatgcagaagaagatggcgcgcatgaccacggccgcgaccgtgacggtgtgggtgccacccggttccgacattcctaaagaccatgcaaaggtcaccgagccatgccccgtgttggcaaggagatttccgttgacgacgatcggcatttcgaccaggacgatgcacacaacaggtgccaccagccacacgatggggtgggacaccatcgcggccacgaggtgagcaacggccaccaaagccgcgaatgacagcaggacgacgattaagtcggaggcttcggcgacggtcggagtcgcattgagccacgtcttagcgaccagcggggccgccacgatgaccgtcccgatgaggagggcagccgcctgccgccagaaccagtgccagtgaatgccaagaatggaccgcgccggagcaacccccacaaccatgtccgaaggtgccgtgcgtgccgctaggcccgcccccatgaggccagccacgatgccccacagcatactggactccaggagcgtgacggcgacatcctgcacttgccacaacccccaagcccatcgacctcgcaacgcaatgaagctgcacatggctcctccgaccgtcacgagaaccatgtgccatgacgtgaaggggaatgccatgcggtgaaaaccgcgcagcggacgtataccctgaagcgaagtgagcatcacgctgcgcccccgagaagagtgaggtatccagcctcagcatcgttggtattacggactgggtgccctcggccaacagattccagttcggaatacgagccctcgaagatcagctttccctcggacaggacgacgagttgcgacacgaagccctggagatcctcaagcaggtgagtcgacacaatgaccgtccgatcttcggcgagctcaccgaagagggatcgcaccccaatccttgatgccgggtcgaggcctaccgtcggctcatcaagcagtagtacagctggatcgccgacaatcgcacacgcgattccaagtcgttgacgcattccacccgacagggactggacgcgctcatcggcgcggtcaagaagcccaacacgatcgagggctgcacatgccctcgcacggcattcgctcggttcaacgtctcgcgcccaggccgcatattccaccgcccgccggatacggaagtgcgacgggagggaaaatcgctggggcaggaatccgaccaaaccacggatggtgtcgacgtcatcgctgacatcgacaccattcacccgaaagtggccggactccggttcacggagtgtcgcgaggatactgagaagtgtcgactttccggccccattcggaccgagcagcccccacaaaccagagccaaactcacaggaaatatcaaccaggctacgccgatggcggtaacggtgtgatacgtgcttgagttcaatcattcacttgaccgtaacgtaacccaatttcgctgatgccatacgacgccctttctgaagcagaaacatctccaatggaaaacccgctaccgcatccatactttcacttaaagtgaggcagtgtcaatcttgtggcaaattcggtggcacatatcgcgctcccgcaattcttctcagaatcgggtcagtacagcattgccgacgccgggtcagagaggatctccgcaacgtcgtggaggaatgtcgaaccctgctcaccgtcaataagacgatgatcgaacccgaggctcatcgtcgtcacccacctgggcacaacgcgctcgtcatcaccggtcccgacgacccacggccgccgagcgagagcaccgagcacgaggatcgctgactctgtccggttgaccacgggagtaccggcatcgagcccgaacaccccgacgttcgtgatcgagaaggtaccgtcggcatagtcgggcggttgcagtttgtcttccttggcgatcgcaacgatccgggtgatctccgtcgccaactcaagcatcgccatgtcctgggcgtcgcgcaccaccggcaccataaggccgcgaggcgtggcggcggcaatgccgaggttgatgtggtcacggaagacgatctggtcagcggcgtcatcccatgcggcgttgatgatgggggtgcgccccatcgccaggcacaccgccttgcaccacaccgtcagcggggagacacgcaggcctttgaaacgacggtcggcacgcagccggttgaccagctccatcgtcggggtgacgtcgcaggtaaggaaggccgtcacgagggccttcgtatccaaggaatccttcacggccttcgctgtgaccttgcgcaccccacgcactggcaccttgcgggtgtggccgtcgggctcggtcggggcgccaccgaggagacgtcgagacatcaccgacaggctcgccagctcggcgtcgccaggacaagcaccgccgtccccggctgcagcagcgccatgatgagcggccgctttgacgtcactcctcgtcactgcaccctgcggaccggtgccggtcacctgagacaagtcgacgccgaggtctgctgccaatcgtcgggccggcggcttggcaagaatgtgcgcggtgcggtccatgcgcggtgggtcttgacgaggagccggctcggtcagacgctgctccggtttcgcctcggcgtcgtgccgagattccgaaaccgattgctcaggatgagtgtctgcac

SEQ ID NO: 77 - DNA, 13940 bp, Propionibacterium acnes
agcaagcacggcaccaaccgggtgatctttcagttgtgccacggcttgacgatgcttctcgtcgagacggacggcttcggtagcctgcaacgcaccgagcacaacccgctgggacgccttgccccacgcctcgaacacctcgtgtgcagcctccgggtccaccgcgatgttccattcacttgtcggcccggtattgccacgataattgatcgccccacccatgacgtgcagcccccgcaacaaccgcggcaattccggttcttcccgcagcgccagcgcgaggttcgtcaacggcccggtgacgatacccaccaacttccccgggtattggcgcgcgagatcaacccacagttgtgccccgctacgcgaatccgggtgacgcccgcactcccctagcacagcgtgccccaacccgtgcggcccgtgggtctcctcggcggtcatgagaggctcgacgagcggaacgtccgcccctcgggcaaccggcacgcccattccgagcagatcagtcaccccaagcgcgtttcgcagtacgtcgtcctgccccacgttgccggcagtcgtcaccaccccgacggtctcaacgtcgtcacggcaggccacgtaggccagggcgaaggcgtcgtcgatacccggatcgcagtccaacaagacgggcagggagcgcgtagaagtcgacatgtcgccacactaaggcttcgaccgttgtggcgtcaccctccgatgcgtccaccaaacttgtagcgggattcatgaagaagcgccgcggaacagaccgtgctccatccccgcgatgatgaactcaattttgagatcgagattcccgcgctcccccatgtcctgcattccgaatagttcgggtagctctccagcgatcctcacaaacttgtccaatccggtgcgaccttcttcatcacaggtcatgtacggctggaccgacatgtacgtctccaaggccgtgtcccccgcgaagtccagggcgaaggctgccccttccttgcccccggggataccgagtgcggccaacctctcaacgatcgccgtgattcgcggtagagctactccgaaggcttcaggccgggtgacaataacggcggccgcctccggatagcggacacacatctgccactgccgatccacgacatcgcgcagcacgtcctgccaggtgcacaactgcggatccggttcgatgtcggcagctatcgcgctgatcgcggcaagctgcaactcctgacgggaactgaactcccggtacaaggcagtggccttcaccccaaggcgctcggcaaccgctcgaagagtgaaactgccaattccttcagctagggtagcgtcaatgacctgacgtcgtgtgaacgcaggtttacgccccggccgttttctcatcacggccgacccacgagcgaccaccccacagcccgttcccgggcatgccacagatcggcatacaggccgctgctggcaatgaggtcgtcatgggttcccacttgacaaaccctaccagtgcgatcgacgacgactatctgatccgccgaacgaatggtgtcgagcttgtgggcgataacgacgattgtcgacgtctgccgcagctgggtcacagcggcctcgacatgggcctcgttctccgggtccaaagccgaggtggcctcgtcgaaaagcagaatcggggcgcgtttgagcaaggcccgagctaccgacacccgctgacgttcgccacccgaaagccgacgacccccttctccgacgctggcatcccaaccgcccggaagacgatcagcaatctcgtcgacaccggccagggctccggcctgacgcacgtgctcatcggtggcgtccgggcaaccgatgcggatattttccgtcagggtggagtcatagaggtacacatcctgaaacaccatggcaagctgactcatgagctgctcagtagtctgatcgcggacatcgaccccaccaactcgcaccgttccggaatcagcatcccagaacctggcaatgagccgaaacagagtggacttgccagcgcccgagggtccgacgatagccgtcaatccgccggccggaacagtgaacgagacgtcgtggaggaccgggcgagcctggtcgtagccgagaggatctcgtcgacctcggcgaccggttcacgcgcagtctcgacggccagggtcgcagcaccgacattctccaacaccttcgtgtagcgcagcgaaaccccgacgaaagccaccgccacgaccgggttcaacgccccgatccgcccaggttcgcggcgagcacgatgagggtcacggcaatgccctgggccgtcaacccgaagacgaagctcgccaacactcctagccacagatccttgcgggcagcacgtctgctggccacctgggcatcatggagaggttgatagccggtggcacgtccagctgcccgcagtgcaggttgagattcacagaactcgactattcgggccgccaattcctgctccgtggggtacgtcaacgcttcaccgcgaagtttgagggcgcgtgaggcgatcgtgaggaggtacatggtcggaatggcaaggagcagggccaaccccaactgccatgaccacatccagcccaggaccatcatgacgagggtagtggtcatgcccttcaccagcggagcggtgaagtgtcccaagcactcgcctagcgtcatgagtccacgcgtcaacaggcgcgagagacgggcgggaaaactcggccgaaaccaccccagcggcaggctggcgacgtgatcaccgatacgggtactgaggtgactcaggatgtctatcgcgcatagataccccgtgctcgactgaaggtacgacaccacagccccggcagcggccagagcagcgagcacccacacccagccccaccaggcaaggcccaacgagggctgccccgcaacgaaagcggtgaacgtcgggatgacggcaaacaggccgactccctcgatcgctcccagcacaccggcccacaccaaggaactgtgcaaccgccgggtgccctcgttggtcaacaatggttggaacgcccgcaccaggaggatgtccccgacccaagaaagacgtgacgacgtggtgctcatcgggtgactccctccatgattcgtcccgccgacagccgcgcccagtagggctgttcggccagttgctcggcggtgccgcaggctgcgatagagccgttctccatgacgcagatgacatcagccccaatcaccgactcggcgtgatgaccgatgaccaacacggttcggcctcgagccaaagcggccagggcctgctggatctcggcctcgcagtctggatcggtggccgcagtcgcctcgtccaggacgagaatcggggcatcggccaacacggcccgcgcaatggacaggcgctgcttctgcccacctgacaagttggtgtcctcacccaggacggtgtcgaaaccggcgggcagggcatcaatgtcgtcgaggattcgggccgtgcgggcggcattgcgaacttgttcttcggtggcatcggggcgagccagggtaatgacgtcacggatggattgacgctgcaagtatgggtcctgcaagacgaaggagacgagtcggtaaaggtcggtcggggagagctccctgaggtccaccccaccgatgcgcaccgtgccgaaatcaggatcgcggaatcgggccaacatcgtcgcgagggtcgacttgcccgacccagacgggcccacgagggccgtgacagtgcccgggcgcagtgtcagagagacgtggttgagggccggaacctcgccgtcaggggtgtggtaggagacgctgatgtcgtcaaaggtgaccgtcgtgtcctcgggaatcgcggagctggtaccaggctcgtcgatctgctcgatagacaggacctcctgcagacgcaacgctgcaccaccagcttgctggtacatccacgccgtgcttccaagcacctcgacggtgcgcggcagcacgagggcgataagggagcaggtgagaacatcggcgacacccacccaaccggccctggccatgagtagaccgaagccgaggttgatcgccatgagcgcaggcaccgagatcaccgactgagacagggcggacgccttgatgagcgggccgcaccagtcccagtaaaaccgggcgaactcctcgcaggcagtggtgaagcgtcggtgggccttgcctgtctgaccgaagttcttgacgacgtggatgccctcggtcaactcgatggcgttggccgagatgttggcaagtttgtcgttcatctcggcggtcttggcggtcatgccccgcatcgaccaccactgcaacagggcatagatcgggaaagtcgccagacagagcagacccagccgccaatccactacgaaggcgtagacgagcagtaccacggggatgccgatcgccgcggtctgctccaccggggcgtgggcgacaagtgcatgcacctggacggtgtcgtcctggatggccttacgcacctgcccggtggacgacgaactgaaccatgccagcggtgcccgggacaggcgcccgatgatgcgaccctgcaggacactgcgcagtttgaggtcagcgaaatgtgtgatgacaacggctagcacgtagagcagggcctgggtgcagaaggccgccaccaacaggttcgcggtatgtacgagggcctcgtggtcgatatgggcgctcagcaggatggtgccgagcttcaccaaggccagatagggggccaaggcgacgacgcaggaggcgatgacgataatccgcgccgccaggattcgtccccggaccggttgcataagcgatgagagggctctacccccggcgcggtgcttggcctgatagtcgtgggaactttcggcagatgcagtttcctgggctgccacggaggctggaggcgacggttgggacgggccaacgatggaggcaggatcccccgaggtggttctgctcacttcgtcagtcccgcccgccggaagtgtttgcgccccaccttgatgcccagccaaccaccgagaagtccaagcaggaacaccgcgacggcccatccggcgaccagaccgggggtaaacagtgctcgcatcttgttggaataatcggcacccatttgcttggtgatcatggcgtagtacttgtcggcgttcacgaccatcggtatcagtggcgcaaccacccaaagggtgaataccgcatagccgagggacgcccggcgcgggtccaggcgaacgttacgcccggcgttggtggtgaccagatcggcgatgaagccgagcacgagcccggcgggaatcatccagatagtgtgcccgggcatcataccgagtccgacgagcagcccggtgatcgtcaaagcgcccattttcgggacccgtgccattgacagcatcacgatgatcccgcccagcagaataccgaggatccagccaacgaacatgaacgccggcccggcgaaaccaatcatcccgcaggcgtagaaggcgacgaagaaaatcaccgcgaaaatggctacggtcaccagatcacgagtggtcaggcgtgatttcatgatttccctttcaaggtggcgatattgaccagaaagtccccgcaccgggccatgagctccgggtcgtgggtgatgacgatgacaaccttcccggcggtggcaagttcaccgacgagatcggcgatcgacgcgagatgtcggcgatcgacacctgaggtcggttcgtcgaaaatgacgacctccttgtcttgcgcgatggtggccgcgacgacgaggcgttgcgcctgcccacccgacaaggacaaggggtggcggtcatgttcgccagccaggtcgagacgtttcagaagtcccgatacgtcggcggcatctcgatgcggaagatccagtccgagggtgacttcacgttctaccgactcgctgaaaagctgacggcgaacgtcctgcatcaccatcccgcaacatttctgacgcctgccgggggtccagggcactcccatgacgatgcgagcttcggtaggggatttttcgagcccgcacacgattcgggccaaggtcgacttccccgcgccattcgggccggtcagaatcgtcaccgccccgccaggcaggaacagggaatcgatgtcgagaatcgtcgagccgggacggtaagagaaggcgaggtgctcgatggtcagccctgccgggatttttgtgcagccggctgaggcgggatcggagcgcatgaacttgcctcggggcaccggagtaagcggagccggagcctgcggcggcgccggcaggtcgaccgggttgacgtcgagactgcgcaagccccgttctagcaagtccccctctgtcagcgcgaaaaggctgctgccgctcattcgctcaacgatctggccattggaaacacgatgcacgtcgtcaacaagtccgcggaacagatgcagccggtgctcagcgatcacaagggtcttgttggcagctttgagctcggtgacgagagcgcgaaaatcgtcgatcccctcagccgagaggttcaaggtcggctcatcgaaaagaagcaggtcgacatcagccaccagcgcgcaggcgcaggcgacccgctggagttctcctcctgaaagggtgtcgaggtggcggtcgagcaggtgagagataccggttcgggaaaccgcacgggagacagcttcgcggatgtcaaccggatcgaccccatagttctccagcccgaaggccagctctgtgcgcacgctggaggtgaagaactgggtacggggattctggaaaatcatcgcggaggtgcggccgacatcgtgcagttcgacaccggccaggtcagtaccttggaccatgacgtggccgcgcaacgttcccccgaagaattgggggacgagtccattcatcgtccgcaatagggtggatttccctgaccccgacgctcctactagcaaggtgagggtgcctggttggatcgtcatcgtgatgccacgaagctgttctacgaactcccgctcgggggccggaccgtcggagaacggcgaggagtcggggtcgaacgaggggtagccgtagctgacgccgttgaggctgacgatgctcacacaatcacctcgctaacacgccacacaaccaacgcggccaaaatcgtcagcacgagggcgtcgccgacacgaaaacgactcggctgggtgttcgatcgggatttttgtgcaccgagtcccttgatgatggcggctgcggaaagttcgtcggcgatgcgggcagccgaggccaggaagggaatgacgacgtactctcccgtacgtatcgggtgacgcacagccgaccgcgccccagggttgaggccgcgcagggtcatggcctggacgattgctcgcagctcgcgtactgccatcgggaagaaccgaaccaccaccatgacgggcacataaatgacgcgcggagcatgcaattgggtgaggaccgcgccgactcgagtgacgtcgaggactttgatcgccgctactgccgcaccaaagactccggcgaaccgaaacatccagaaggcgatgaagaccaggaacgccgatactgtcgagcgccacagcactgggagtaggaagcagcagaaaatccacaccagcacgaagatcgtccagctgatccaggacttcgaccgggtagtcaagaccaagaacacccacaccactccaagactggtcatcacgagggctgttgatcctgctcccatgagtaggacgttgagaacgatgacgtagagggcgagggtgcgtggatccaccgcgccgaagagctgccgagatcggcgagtgtggaacgccgaagcagcatcgaaacctatcccggcaaccgagcgactatggggaacgcggtgagtggctccgggcagcgccagggtcgcctcatcatgtttcataaggtaaccctatctcataactgattgctgttaacaaataccttctctcccacgttgacccagagttggccatgatggcgccatatgagctccctgccaccacgtgaggcacgatggaggggccgacgaccagttaccgaagaacaggtgtgagcatgactgacgtggagaagtccccgactcgcggtgagaggattctcgccgctgtggtcgccttcaccctctggatggccgtgatattcgcgattgtggcgatcttcgtcggctggcggtggtctctgcggatgttcgtcggggtgctcctcatcggtatccccggagagatcgttatggagctcgtcggtcggggaccgttgctgccgagcggcgcgtcgagaatacggcgttcccgtggttcgcggttactcctctcggcactcatccttatcgtgtgggcgttcatcgttctcgcggcgattgcgctcattcagccctggtacggcgctaccggtgacatggcctgggtgatggtcgtagggatcgcggcgatcctcgtgcaggagggcaccgacacccgcaagaagaagtcctgatcatctctcatgaagggcttgtcggctcctcgcatacaagggggtcgatagtggtggccggaacgtgcgggtttgatctcgccacaatcatggataccgccagctttggtgtccgtccctgccacaaagcatcacaaaagcatcggtttacacgtcagcatcgctgctgcggttgatcgtgaggccacctgagaccattcagggcaggctcacccattcccttccgatttacacctcgtgcgaactcgcaccgcctacaattccagagcaacgacgcctcatccccgtcgccatagtcaggaaaacactgatgatgcccagggtccgcccgtgacgaagaagagctccctcgtcctggcgatggcgtccatcggtgccatcgctgttgggctgaccgggcgtgctcgtcagctcaccctcgccttcaactccgcgagttggctcgtcgccgtcatcgcgctgagctatctcatccgctccgggcacagcgaaaaaacagcatggctggcccaaccaccgagggtgcccgaggcacagccgccaggcggttgacggtctcctcgacgtgcattctcacaccatcgcacggcgaacatccaccgatccgctgcccaagcacggctaccctggaactcagttgagtgagaggagacccgcgtgggcatcggaagcaacatcggcaaggcactgttggcccaagcccccgacatggcacccggcgcagctgtctcactactacgcagcatcctcggattcgctatcgacggcgcctcagggctgccgggagcgcgtcaggctgccggcaagacgctcaccaagcacgagggcgatattgagcaggcgatcagctccttagtcaatcagcacattgcgatggccggggcccaggggttcgtctccaacctcggtggcgtcgtcactctggccgtgactatccccgccaatatctccggcgttgcgatcgtgcaagcccgcatggtggctgccatcgcccacctgcgcgggtacgatctcgacgaccagcgggtccgcaccgccatcctcgccactctcatgggtcagcgcgaggtcgatagcctcgtccacgaggagaagctaccgacgacaccgatgggcatcgctaccgctccagtcggtgacgccgatctcgaaaaggtcgtcgcccggaacctcgtcaatgtccttatggggcaggtcgcaggtaagaagctgcctgtgttcgtctccaagcgcgttcctgtacttggcggcggagtcggtgccaccgctgacggattcaccacgtggagcgtggcccgctacgcccgtaagcaattccccacccgccgtccacgcacctgagacccgcacactcgggatacggccaggacgattcgggggcaggaatagtggcgtccgaccacagtgacaggatctggccgggattcaacgacgcagggatttcaccccgcccagcccccatgcgtacccgacaacacctaggaaggcacaaacgacggcacacaccatggccatggtagacactgtcggcgcactcccctcgacggcggccgtttttcctggatagccgccggggaggaatcgcaggagggtcttcgactgtgcgacgaccacaaccaggtagatcaggggaccgcacaatggcccgactcgccgtgacaccattcccgtgacgaacaatgcgataccggtacacagcacgcaagtcaccgagaaccctatgaatggcggccacggcagctgaaaccgtgcgggaatttgcggtaccaggacggaatcaccatcaggtatcaactcaacgggcaacgatcgcagtacccatcctatgagcaatggaagaccagctgcacagccgcatatccacagccccatccacgcatatccaaccgtgagggaccgaaccgatgtcctctcgacccaatccatggccgatgagacacaccacatgatggtggcacaacccaccagaatgatcagctcgggaccagtcacagggcgatcccacacgtctctcggcgccaccgacagactcgccttccacaggaagaaggccacgagcaaggccacaagcggcgcaatgacaagggcactagcatggcgccccttcaggaaagtcgctacgcctctcatcggtgaagatcactggaggtcaatgaacacgtgcttaccgcatgatgatgctccgtataccaatgacggaatgcggttacatccatgccgtcaaggccatttcgttccgaactcgtcgcatcatcatgctgaaatccagccagccgaagaatggtacgttccacggaatcgacgccattgagggcccccatctgctgagatgtcaactccgaccctccggtctcacgcataaaagcacatgcgtcccggcctgaaaatgattgagccagcccctcacccgtcagatccgacatttgttgtctagagccatgtgaggtcggtcggccgagatcaatcacacgttgccccctgtatgtttggtacccagactcagcaagcaggacgtcacgggaaaccaccgtttgcggcaggacagacaagacgcgttgagcgggtttcgcgtaggacgccgcgagactccgatgtgctggcgtgacgcatacccgcacaccttcgtgcgacgaacactcaaaggctagtggcgcatcacgaaacaacggcaccggcaagacgacgcccacggcagcaatgatgagcggtggggcgatcaaggccacacaaggcatcactcgacgccagcagaacctgtcggcacggaccctggaccaacggctggcggtgaggatacaggacaaggtgacgatgcagaagaagatggcgcgcatgaccacggccgcgaccgtgacggtgtgggtgccacccggttccgacattcctaaagaccatgcaaaggtcaccgagccatgccccgtgttggcaaggagatttccgttgacgacgatcggcatttcgaccaggacgatgcacacaacaggtgccaccagccacacgatggggtgggacaccatcgcggccacgaggtgagcaacggccaccaaagccgcgaatgacagcaggacgacgattaagtcggaggcttcggcgacggtcggagtcgcattgagccacgtcttagcgaccagcggggccgccacgatgaccgtcccgatgaggagggcagccgcctgccgccagaaccagtgccagtgaatgccaagaatggaccgcgccggagcaacccccacaaccatgtccgaaggtgccgtgcgtgccgctaggcccgcccccatgaggccagccacgatgccccacagcatactggactcccggagcgtgacggcgacatcctgcacttgccacaacccccaagcccatcgacctcgcaacgcaatgaagctgcacatggctcctccgaccgtcacgagaaccatgtgccatgacgtgaaggggaatgccatgcggtgaaaaccgcgcagcggacgtataccctgaagcgaagtgagcatcacgctgcgcccccgagaagagtgaggtatccagcctcagcatcgttggtattacggactgggtgccctcggccaacagattccagttcggaatacgagccctcgaagatcagctttccctcggacaggacgacgagttgcgacacgaagccctggagatcctcaagcaggtgagtcgacacaatgaccgtccgatcttcggcgagctcaccgaagagggatcgcaccccaatccttgatgccgggtcgaggcctaccgtcggctcatcaagcagtagtacagctggatcgccgacaatcgcacacgcgattccaagtcgttgacgcattccacccgacagggactggacgcgctcatcggcgcggtcaagaagcccaacacgatcgagggctgcacatgccctcgcacggcattcgctcggttcaacgtctcgcgcccaggccgcatattccaccgcccgccggatacggaagtgcgacgggagggaaaatcgctggggcaggaatccgaccaaaccacggatggtgtcgacgtcatcgctgacatcgacaccattcacccgaaagtggccggactccggttcacggagtgtcgcgaggatactgagaagtgtcgactttccggccccattcggaccgagcagcccccacaaaccagagccaaactcacaggaaatatcaaccaggctacgccgatggcggtaacggtgtgatacgtgcttgagttcaatcattcacttgaccgtaacgtaacccaatttcgctgatgccatacgacgccctttctgaagcagaaacatctccaatggaaaacccgctaccgcatccatactttcacttaaagtgaggcagtgtcaatcttgtggcaaattcggtggcacatatcgcgctcccgcaattcttctcagaatcgggtcagtacagcattgccgacgccgggtcagagaggatctccgcaacgtcgtggaggaatgtcgaaccctgctcaccgtcaataagacgatgatcgaacccgaggctcatcgtcgtcacccacctgggcacaacgcgctcgtcatcaccggtcccgacgacccacggccgccgagcgagagcaccgagcacgaggatcgctgactctgtccggttgaccacgggagtaccggcatcgagcccgaacaccccgacgttcgtgatcgagaaggtaccgtcggcatagtcgggcggttgcagtttgtcttccttggcgatcgcaacgatccgggtgatctccgtcgccaactcaagcatcgccatgtcctgggcgtcgcgcaccaccggcaccataaggccgcgaggcgtggcggcggcaatgccgaggttgatgtggtcacggaagacgatctggtcagcggcgtcatcccatgcggcgttgatgatgggggtgcgccccatcgccaggcacaccgccttgcaccacaccgtcagcggggagacacgcaggcctttgaaacgacggtcggcacgcagccggttgaccagctccatcgtcggggtgacgtcgcaggtaaggaaggccgtcacgagggccttcgtatccaaggaatccttcacggccttcgctgtgaccttgcgcaccccacgcactggcaccttgcgggtgtggccgtcgggctcggtcggggcgccaccgaggagacgtcgagacatcaccgacaggctcgccagctcggcgtcgccaggacaagcaccgccgtccccggctgcagcagcgccatgatgagcggccgctttgacgtcactcctcgtcactgcaccctgcggaccggtgccggtcacctgagacaagtcgacgccgaggtctgctgccaatcgtcgggccggcggcttggcaagaatgtgcgcggtgcggtccatgcgcggtgggtcttgacgaggagccggctcggtcagacgctgctccggtttcgcctcggcgtcgtgccgagattccgaaaccgattgctcaggatgagtgtctgcac

SEQ ID NO: 78 - DNA, 11835 bp, Propionibacterium acnes
gtagccgagaggatctcgtcgacctcggcgaccggttcacgcgcagtctcgacggccagggtcgcagcaccgacattctccaacaccttcgtgtagcgcagcgaaaccccgacgaaagccaccgccacgaccgggttcaacgccccgatccgcccaggttcgcggcgagcacgatgagggtcacggcaatgccctgggccgtcaacccgaagacgaagctcgccaacactcctagccacagatccttgcgggcagcacgtctgctggccacctgggcatcatggagaggttgatagccggtggcacgtccagctgcccgcagtgcaggttgagattcacagaactcgactattcgggccgccaattcctgctccgtggggtacgtcaacgcttcaccgcgaagtttgagggcgcgtgaggcgatcgtgaggaggtacatggtcggaatggcaaggagcagggccaaccccaactgccatgaccacatccagcccaggaccatcatgacgagggtagtggtcatgcccttcaccagcggagcggtgaagtgtcccaagcactcgcctagcgtcatgagtccacgcgtcaacaggcgcgagagacgggcgggaaaactcggccgaaaccaccccagcggcaggctggcgacgtgatcaccgatacgggtactgaggtgactcaggatgtctatcgcgcatagataccccgtgctcgactgaaggtacgacaccacagccccggcagcggccagagcagcgagcacccacacccagccccaccaggcaaggcccaacgagggctgccccgcaacgaaagcggtgaacgtcgggatgacggcaaacaggccgactccctcgatcgctcccagcacaccggcccacaccaaggaactgtgcaaccgccgggtgccctcgttggtcaacaatggttggaacgcccgcaccaggaggatgtccccgacccaagaaagacgtgacgacgtggtgctcatcgggtgactccctccatgattcgtcccgccgacagccgcgcccagtagggctgttcggccagttgctcggcggtgccgcaggctgcgatagagccgttctccatgacgcagatgacatcagccccaatcaccgactcggcgtgatgaccgatgaccaacacggttcggcctcgagccaaagcggccagggcctgctggatctcggcctcgcagtctggatcggtggccgcagtcgcctcgtccaggacgagaatcggggcatcggccaacacggcccgcgcaatggacaggcgctgcttctgcccacctgacaagttggtgtcctcacccaggacggtgtcgaaaccggcgggcagggcatcaatgtcgtcgaggattcgggccgtgcgggcggcattgcgaacttgttcttcggtggcatcggggcgagccagggtaatgacgtcacggatggattgacgctgcaagtatgggtcctgcaagacgaaggagacgagtcggtaaaggtcggtcggggagagctccctgaggtccaccccaccgatgcgcaccgtgccgaaatcaggatcgcggaatcgggccaacatcgtcgcgagggtcgacttgcccgacccagacgggcccacgagggccgtgacagtgcccgggcgcagtgtcagagagacgtggttgagggccggaacctcgccgtcaggggtgtggtaggagacgctgatgtcgtcaaaggtgaccgtcgtgtcctcgggaatcgcggagctggtaccaggctcgtcgatctgctcgatagacaggacctcctgcagacgcaacgctgcaccaccagcttgctggtacatccacgccgtgcttccaagcacctcgacggtgcgcggcagcacgagggcgataagggagcaggtgagaacatcggcgacacccacccaaccggccctggccatgagtagaccgaagccgaggttgatcgccatgagcgcaggcaccgagatcaccgactgcgatagggcggacgccttgatgagcgggccgcaccagtcccagtaaaaccgggcgaactcctcgcaggcagtggtgaagcgtcggtgggccttgcctgtctgaccgaagttcttgacgacgtggatgccctcggtcaactcgatggcgttggccgagatgttggcaagtttgtcgttcatctcggcggtcttggcggtcatgccccgcatcgaccaccactgcaacagggcatagatcgggaaagtcgccagacagagcagacccagccgccaatccactacgaaggcgtagacgagcagtaccacggggatgccgatcgccgcggtctgctccaccggggcgtgggcgacaagtgcatgcacctggacggtgtcgtcctggatggccttacgcacctgcccggtggacgacgaactgaaccatgccagcggtgcccgggacaggcgcccgatgatgcgaccctgcaggacactgcgcagtttgaggtcagcgaaatgtgtgatgacaacggctagcacgtagagcagggcctgggtgcagaaggccgccaccaacaggttcgcggtatgtacgagggcctcgtggtcgatatgggcgctcagcaggatggtgccgagcttcaccaaggccagatagggggccaaggcgacgacgcaggaggcgatgacgataatccgcgccgccaggattcgtccccggaccggttgcataagcgatgagagggctctacccccggcgcggtgcttggcctgatagtcgtgggaactttcggcagatgcagtttcctgggctgccacggaggctggaggcgacggttgggacgggccaacgatggaggcaggatcccccgaggtggttctgctcacttcgtcagtcccgcccgccggaagtgtttgcgccccaccttgatgcccagccaaccaccgagaagtccaagcaggaacaccgcgacggcccatccggcgaccagaccgggggtaaacagtgctcgcatcttgttggaataatcggcacccatttgcttggtgatcatggcgtagtacttgtcggcgttcacgaccatcggtatcagtggcgcaaccacccaaagggtgaataccgcatagccgagggacgcccggcgcgggtccaggcgaacgttacgcccggcgttggtggtgaccagatcggcgatgaagccgagcacgagcccggcgggaatcatccagatagtgtgcccgggcatcataccgagtccgacgagcagcccggtgatcgtcaaagcgcccattttcgggacccgtgccattgacagcatcacgatgatcccgcccagcagaataccgaggatccagccaacgaacatgaacgccggcccggcgaaaccaatcatcccgcaggcgtagaaggcgacgaagaaaatcaccgcgaaaatggctacggtcaccagatcacgagtggtcaggcgtgatttcatgatttccctttcaaggtggcgatattgaccagaaagtccccacaccgggccatgagctccgggtcgtgggtgatgacgatgacaaccttcccggcggtggcaagttcaccgacgagatcggcgatcgacgcgagatgtcggcgatcgacacctgaggtcggttcgtcgaaaatgacgacctccttgtcttgcgcgatggtggccgcgacgacgaggcgttgcgcctgcccacccgacaaggacaaggggtggcggtcatgttcgccagccaggtcgagacgtttcagaagtcccgatacgtcggcggcatctcgatgcggaagatccagtccgagggtgacttcacgttctaccgactcgctgaaaagctgacggcgaacgtcctgcatcaccatcccgcaacatttctgacgcctgccgggggtccagggcactcccatgacgatgcgagcttcggtaggggatttttcgagcccgcacacgattcgggccaaggtcgacttccccgcgccattcgggccggtcagaatcgtcaccgccccgccaggcaggaacagggaatcgatgtcgagaatcgtcgagccgggacggtaagagaaggcgaggtgctcgatggtcagccctgcggggatttttgtgcagccggctgaggcgggatcggagcgcatgaacttgcctcggggcaccggagtaagcggagccggagcctgcggcggcgccggcaggtcgaccgggttgacgtcgagactgcgcaagccccgttctagcaagtccccctctgtcagcgcgaaaaggctgctgccgctcattcgctcaacgatctggccattggaaacacgatgcacgtcgtcaacaagtccgcggaacagatgcagccggtgctcagcgatcacaagggtcttgttggcagctttgagctcggtgacgagagcgcgaaaatcgtcgatcccctcagccgagaggttcaaggtcggctcatcgaaaagaagcaggtcgacatcagccaccagcgcgcaggcgcaggcgacccgctggagttctcctcctgaaagggtgtcgaggtggcggtcgagcaggtgagagataccggttcgggaaaccgcacgggagacagcttcgcggatgtcaaccggatcgaccccatagttctccagcccgaaggccagctctgtgcgcacgctggaggtgaagaactgggtacggggattctggaaaatcatcgcggaggtgcggccgacatcgtgcagttcgacaccggccaggtcagtaccttggaccatgacgtggccgcgcaacgttcccccgaagaattgggggacgagtccattcatcgtccgcaatagggtggatttccctgaccccgacgctcctactagcaaggtgagggtgcctggttggatcgtcatcgtgatgccacgaagctgttctacgaactcccgctcgggggccggaccgtcggagaacggcgaggagtcggggtcgaacgaggggtagccgtagctgacgccgttgaggctgacgatgctcacacaatcacctcgctaacacgccacacaaccaacgcggccaaaatcgtcagcacgagggcgtcgccgacacgaaaacgactcggctgggtgttcgatcgggatttttgtgcaccgagtcccttgatgatggcggctgcggaaagttcgtcggcgatgcgggcagccgaggccaggaagggaatgacgacgtactctcccgtacgtatcgggtgacgcacagccgaccgcgccccagggttgaggccgcgcagggtcatggcctggacgattgctcgcagctcgcgtactgccatcgggaagaaccgaaccaccaccatgacgggcacataaatgacgcgcggagcatgcaattgggtgaggaccgcgccgactcgagtgacgtcgaggactttgatcgccgctactgccgcaccaaagactccggcgaaccgaaacatccagaaggcgatgaagaccaggaacgccgatactgtcgagcgccacagcactgggagtaggaagcagcagaaaatccacaccagcacgaagatcgtccagctgatccaggacttcgaccgggtagtcaagaccaagaacacccacaccactccaagactggtcatcacgagggctgttgatcctgctcccatgagtaggacgttgagaacgatgacgtagagggcgagggtgcgtggatccaccgcgccgaagagctgccgagatcggcgagtgtggaacgccgaagcagcatcgaaacctatcccggcaaccgagcgactatggggaacgcggtgagtggctccgggcagcgccagggtcgcctcatcatgtttcataaggtaaccctatctcataactgattgctgttaacaaataccttctctcccacgttgacccagagttggccatgatggcgccatatgagctccctgccaccacgtgaggcacgatggaggggccgacgaccagttaccgaagaacaggtgtgagcatgactgacgtggagaagtccccgactcgcggtgagaggattctcgccgctgtggtcgccttcaccctctggatggccgtgatattcgcgattgtggcgatcttcgtcggctggcggtggtctctgcggatgttcgtcggggtgctcctcatcggtatccccggagagatcgttatggagctcgtcggtcggggaccgttgctgccgagcggcgcgtcgagaatacggcgttcccgtggttcgcggttactcctctcggcactcatccttatcgtgtgggcgttcatcgttctcgcggcgattgcgctcattcagccctggtacggcgctaccggtgacatggcctgggtgatggtcgtagggatcgcggcgatcctcgtgcaggagggcaccgacacccgcaagaagaagtcctgatcatctctcatgaagggcttgtcggctcctcgcatacaagggggtcgatagtggtggccggaacgtgcgggtttgatctcgccacaatcatggataccgccagctttggtgtccgtccctgccacaaagcatcacaaaagcatcggtttacacgtcagcatcgctgctgcggttgatcgtgaggccacctgagaccattcagggcaggctcaccgattcccttccgatttacacctcgtgcgaactcgcaccgcctacaattccagagcaacgacgcctcatccccgtcgccatagtcaggaaaacactgatgatgcccagggtccgcccgtgacgaagaagagctccctcgtcctggcgatggcgtccatcggtgccatcgctgttgggctgaccgggcgtgctcgtcagctcaccctcgccttcaactccgcgagttggctcgtcgccgtcatcgcgctgagctatctcatccgctccgggcacagcgaaaaaacagcatggctggcccaaccaccgagggtgcccgaggcacagccgccaggcggttgacggtctcctcgacgtgcattctcacaccatcgcacggcgaacatccaccgatccgctgcccaagcacggctaccctggaactcagttgagtgagaggagacccgcgtgggcatcggaagcaacatcggcaaggcactgttggcccaagcccccgacatggcacccggcgcagctgtctcactactacgcagcatcctcggattcgctatcgacggcgcctcagggctgccgggagcgcgtcaggctgccggcaagacgctcaccaagcacgagggcgatattgagcaggcgatcagctccttagtcaatcagcacattgcgatggccggggcccaggggttcgtctccaacctcggtggcgtcgtcactctggccgtgactatccccgccaatatctccggcgttgcgatcgtgcaagcccgcatggtggctgccatcgcccacctgcgcgggtacgatctcgacgaccagcgggtccgcaccgccatcctcgccactctcatgggtcagcgcgaggtcgatagcctcgtccacgaggagaagctaccgacgacaccgatgggcatcgctaccgctccagtcggtgacgccgatctcgaaaaggtcgtcgcccggaacctcgtcaatgtccttatggggcaggtcgcaggtaagaagctgcctgtgttcgtctccaagcgcgttcctgtacttggcggcggagtcggtgccaccgctgacggattcaccacgtggagcgtggcccgctacgcccgtaagcaattccccacccgccgtccacgcacctgagacccgcacactcgggatacggccaggacgattcgggggcaggaatagtggcgtccgaccacagtgacaggatctggccgggattcaacgacgcagggatttcaccccgcccagcccccatgcgtacccgacaacacctaggaaggcacaaacgacggcacacaccatggccatggtagacactgtcggcgcactcccctcgacggcggccgtttttcctggatagccgccggggaggaatcgcaggagggtcttcgactgtgcgacgaccacaaccaggtagatcaggggaccgcacaatggcccgactcgccgtgacaccattcccgtgacgaacaatgcgataccggtacacagcacgcaagtcaccgagaaccctatgaatggcggccacggcagctcaaaccgtgcgggaatttgcggtaccaggacggaatcaccatcaggtatcaactcaacgggcaacgatcgcagtacccatcctatgagcaatggaagaccagctgcacagccgcatatccacagccccatccacgcatatccaaccgtgagggaccgaaccgatgtcctctcgacccaatccatggccgatgagacacaccacatgatggtggcacaacccaccagaatgatcagctcgggaccagtcacagggcgatcccacacgtctctcggcgccaccgacagactcgccttccacaggaagaaggccacgagcaaggccacaagcggcgcaatgacaagggcactagcatggcgccccttcaggaaagtcgctacgcctctcatcggtgaagatcactggaggtcaatgaacacgtgcttaccgcatgatgatgctccgtataccaatgacggaatgcggttacatccatgccgtcaaggccatttcgttccgaactcgtcgcatcatcatgctgaaatccagccagccgaagaatggtacgttccacggaatcgacgccattgagggcccccatctgctgagatgtcaactccgaccctccggtctcacgcataaaagcacatgcgtcccggcctgaaaatgattgagccagcccctcacccgtcagatccgacatttgttgtctagagccatgtgaggtcggtcggccgagatcaatcacacgttgccccctgtatgtttggtacccagactcagcaagcaggacgtcacgggaaaccaccgtttgcggcaggacagacaagacgcgttgagcgggtttcgcgtaggacgccgcgagactccgatgtgctggcgtgacgcatacccgcacaccttcgtgcgacgaacactcaaaggctagtggcgcatcacgaaacaacggcaccggcaagacgacgcccacggcagcaatgatgagcggtggggcgatcaaggccacacaaggcatcactcgacgccagcagaacctgtcggcacggaccctggaccaacggctggcggtgaggatacaggacaaggtgacgatgcagaagaagatggcgcgcatgaccacggccgcgaccgtgacggtgtgggtgccacccggttccgacattcctaaagaccatgcaaaggtcaccgagccatgccccgtgttggcaaggagatttccgttgacgacgatcggcatttcgaccaggacgatgcacacaacaggtgccaccagccacacgatggggtgggacaccatcgcggccacgaggtgagcaacggccaccaaagccgcgaatgacagcaggacgacgattaagtcggaggcttcggcgacggtcggagtcgcattgagccacgtcttagcgaccagcggggccgccacgatgaccgtcccgatgaggagggcagccgcctgccgccagaaccagtgccagtgaatgccaagaatggaccgcgccggagcaacccccacaaccatgtccgaaggtgccgtgcgtgccgctaggcccgcccccatgaggccagccacgatgccccacagcatactggactcccggagcgtgacggcgacatcctgcacttgccacaacccccaagcccatcgacctcgcaacgcaatgaagctgcacatggctcctccgaccgtcacgagaaccatgtgccatgacgtgaaggggaatgccatgcggtgaaaaccgcgcagcggacgtataccctgaagcgaagtgagcatcacgctgcgcccccgagaagagtgaggtatccagcctcagcatcgttggtattacggactgggtgccctcggccaacagattccagttcggaatacgagccctcgaagatcagctttccctcggacaggacgacgagttgcgacacgaagccctggagatcctcaagcaggtgagtcgacacaatgaccgtccgatcttcggcgagctcaccgaagagggatcgcaccccaatccttgatgccgggtcgaggcctaccgtcggctcatcaagcagtagtacagctggatcgccgacaatcgcacacgcgattccaagtcgttgacgcattccacccgacagggactggacgcgctcatcggcgcggtcaagaagcccaacacgatcgagggctgcacatgccctcgcacggcattcgctcggttcaacgtctcgcgcccaggccgcatattccaccgcccgccggatacggaagtgcgacgggagggaaaatcgctggggcaggaatccgaccaaaccacggatggtgtcgacgtcatcgctgacatcgacaccattcacccgaaagtggccggactccggttcacggagtgtcgcgaggatactgagaagtgtcgactttccggccccattcggaccgagcagcccccacaaaccagagccaaactcacaggaaatatcaaccaggctacgccgatggcggtaacggtgtgatacgtgcttgagttcaatcattcacttgaccgtaacgtaacccaatttcgctgatgccatacgacgccctttctgaagcagaaacatctccaatggaaaacccgctaccgcatccatactttcacttaaagtgaggcagtgtcaatcttgtggcaaattcggtggcacatatcgcgctcccgcaattcttctcagaatcgggtcagtacagcattgccgacgccgggtcagagaggatctccgcaacgtcgtggaggaatgtcgaaccctgctcaccgtcaataagacgatgatcgaacccgaggctcatcgtcgtcacccacctgggcacaacgcgctcgtcatcaccggtcccgacgacccacggccgccgagcgagagcaccgagcacgaggatcgctgactctgtccggttgaccacgggagtaccggcatcgagcccgaacaccccgacgttcgtgatcgagaaggtaccgtcggcatagtcgggcggttgcagtttgtcttccttggcgatcgcaacgatccgggtgatctccgtcgccaactcaagcatcgccatgtcctgggcgtcgcgcaccaccggcaccataaggccgcgaggcgtggcggcggcaatgccgaggttgatgtggtcacggaagacgatctggtcagcggcgtcatcccatgcggcgttgatgatgggggtgcgccccatcgccaggcacaccgccttgcaccacaccgtcagcggggagacacgcaggcctttgaaacgacggtcggcacgcagccggttgaccagctccatcgtcggggtgacgtcgcaggtaaggaaggccgtcacgagggccttcgtatccaaggaatccttcacggccttcgctgtgaccttgcgcaccccacgcactggcaccttgcgggtgtggccgtcgggctcggtcggggcgccaccgaggagacgtcgagacatcaccgacaggctcgccagctcggcgtcgccaggacaagcaccgccgtccccggctgcagcagcgccatgatgagcggccgctttgacgtcactcctcgtcactgcaccctgcggaccggtgccggtcacctgagacaagtcgacgccgaggtctgctgccaatcgtcgggccggcggcttggcaagaatgtgcgcggtgcggtccatgcgcggtgggtcttgacgaggagccggctcggtcagacgctgctccggtttcgcctcggcgtcgtgccgagattccgaaaccgattgctcaggatgagtgtctgcac

SEQ ID NO: 79 - DNA, 2113 bp, Propionibacterium acnes
agcaagcacggcaccaaccgggtgatctttcagttgtgccacggcttgacgatgcttctcgtcgagacggacggcttcggtagcctgcaacgcaccgagcacaacccgctgggacgccttgccccacgcctcgaacacctcgtgtgcagcctccgggtccaccgcgatgttccattcacttgtcggcccggtattgccacgataattgatcgccccacccatgacgtgcagcccccgcaacaaccgcggcaattccggttcttcccgcagcgccagcgcgaggttcgtcaacggcccggtgacgatacccaccaacttccccgggtattggcgcgcgagatcaacccacagttgtgccccgctacgcgaatccgggtgacgcccgcactcccctagcacagcgtgccccaacccgtgcggcccgtgggtctcctcggcggtcatgagaggctcgacgagcggaacgtccgcccctcgggcaaccggcacgcccattccgagcagatcagtcaccccaagcgcgtttcgcagtacgtcgtcctgccccacgttgccggcagtcgtcaccaccccgacggtctcaacgtcgtcacggcaggccacgtaggccagggcgaaggcgtcgtcgatacccggatcgcagtccaacaagacgggcagggagcgcgtagaagtcgacatgtcgccacactaaggcttcgaccgttgtggcgtcaccctccgatgcgtccaccaaacttgtagcgggattcatgaagaagcgccgcggaacagaccgtgctccatccccgcgatgatgaactcaattttgagatcgagattcccgcgctcccccatgtcctgcattccgaatagttcgggtagctctccagcgatcctcacaaacttgtccaatccggtgcgaccttcttcatcacaggtcatgtacggctggaccgacatgtacgtctccaaggccgtgtcccccgcgaagtccagggcgaaggctgccccttccttgcccccggggataccgagtgcggccaacctctcaacgatcgccgtgattcgcggtagagctactccgaaggcttcaggccgggtgacaataacggcggccgcctccggatagcggacacacatctgccactgccgatccacgacatcgcgcagcacgtcctgccaggtgcacaactgcggatccggttcgatgtcggcagctatcgcgctgatcgcggcaagctgcaactcctgacgggaactgaactcccggtacaaggcagtggccttcaccccaaggcgctcggcaaccgctcgaagagtgaaactgccaattccttcagctagggtagcgtcaatgacctgacgtcgtgtgaacgcaggtttacgccccggccgttttctcatcacggccgacccacgagcgaccaccccacagcccgttcccgggcatgccacagatcggcatacaggccgctgctggcaatgaggtcgtcatgggttcccacttgacaaaccctaccagtgcgatcgacgacgactatctgatccgccgaacgaatggtgtcgagcttgtgggcgataacgacgattgtcgacgtctgccgcagctgggtcacagcggcctcgacatgggcctcgttctccgggtccaaagccgaggtggcctcgtcgaaaagcagaatcggggcgcgtttgagcaaggcccgagctaccgacacccgctgacgttcgccacccgaaagccgacgacccccttctccgacgctggcatcccaaccgcccggaagacgatcagcaatctcgtcgacaccggccagggctccggcctgacgcacgtgctcatcggtggcgtccgggcaaccgatgcggatattttccgtcagggtggagtcatagaggtacacatcctgaaacaccatggcaagctgactcatgagctgctcagtagtctgatcgcggacatcgaccccaccaactcgcaccgttccggaatcagcatcccagaacctggcaatgagccgaaacagagtggacttgccagcgcccgagggtccgacgatagccgtcaatccgccggccggaacagtgaacgagacgtcgtggaggaccgggcgagcctggtcgtagccga

SEQ ID NO: 80 - DNA, 11827 bp, Propionibacterium acnes
aggatctcgtcgacctcggcaaccggttcacgcgcggtctcgatggccagggtcgcggcacagacatcctccaacaccttcgtgtagcgcagcgaaaccccgacgaaggccaccgccacgaccgggctcaaccgtcctgatccgcccaggttcgcagcgagcacgatgagggtcacggcaatgccctgggccgccagcccggagacgaaattcgccaacactcctagccacagatccttgcgggcagcacgtccgctggccacctgggcatcatggagaggttgatagccgctggcgcgtccggctgcccgcagtgcaggctgggattcgcagaactcgactattcgggccgccaattcctgctcagtggggtacgtcaacgcttcaccgcgaagtttgagggcgcgtgaggcgatcgtgaggaggtagatggtcggaatggcaaggagcagggccaaccccaactgccatgaccacatccaggccaggaccatcatgacgagggtagtggtcatgcccttcaccagcggagcggtgaagtgtcccaagcactcgcccagcgtcatgagtccacgcgtcaacaggcgcgagagacgggcgggaaaactcggccggaaccaccccagcggcagactggcgacgtgatcaccgatacggatgctgaggtgactcaggatatctatcgcacatagataccccgtgctcgactgaaggtacgacaccacagccccggcagcaaccaggacagcgagcacccacacccaaccccaccaggcaagacccaacgagggctgccccgcaacgaaagcggtgaacgtcgggatgacggcaaacaggccgactccctcgatcgctcctaacacaccggcccacaccaaggagctgtggaaccgccgggtgccctcgctggtcagcaatggttggaacgcccgcaccaggaggatgtccccgacccaggaaagacgtgacgacgtggtgctcatcgggtgactccctccatgattcgtcccgccgacagccgcacccagtagggctgttcggccagttgctcgacggtgccgcaggctgcgatagagccgttctccatgacgcagatgacatcagccccaatcaccgactcggcgtgatgaccgatgaccaacacggttcggcctcgagccaaagcggccagggcctgctggatctcggcctcgcagtctggatcggtggctgcagtcgcctcgtccaggacgaggatcggggcatcggccaacacggcccgcgcaatggacaggcgctgcttctgtccacctgacaagttggtgtcctcacccaggacggtgtcgaaaccggcgggcagggcatcaatgtcgtcgaggattcgagccgtgcgggcagcgtcacgaacctgttgttcggtggcatcgggacgagccaaggtgatgacgtcacggatggattgacgctgcaggtatgggtcctgcaagacgaaggagacgagtcggtaaaggtcggtcgaggggagctccctgaggtctaccccaccgatgcgcaccgtgccgaaatcaggatcacggaatcgggccaacatcgtcgcgagggtcgacttacctgacccagacgggcccacgagggccgtgacggtgcccgggcgcagtgtcaaggagacgtggttgagggccggaacctcgccgtcaggggtgtggtaggagacgctgatgtcgtcaaaggtgaccgtcgtgtcctcgggaatcgcggagctggtaccaggctcgtcgatctgctcgatagacaggacctcttgcagacgcaacgctgcaccaccagcttgctggtacatccacgccgtgcttccaagcacctcgacggtgtgcggcagcacgagggcgatgagggagcaggtgagaacatcggcaacacccacccagccggccctagccatgagtagaccgaagccgaagttgatcgccatgagcgcaggcaccgagatcaccgactgcgatagggcggacgccttaatgagcgggccgcaccagtcccagtaaaaccgggcgaactcctcgcaggtagtggtgaagcgtcggtgggccttgcctgtctgaccgaagttcttgacgacgtggacgccctcggtcaattcgatggcgttggccgagatatcggcaagtttgtcgtccatctcggcggtcttggcggtcatgccccgcatcgaccaccactgcaacagggcatagatcgggaaagtcgctagacagagcagacccaaccgccaatccactatgaaggcgtagacgagcagcaccacggggatgccgatcgccgcagtctgatccaccggggcgtgggcgacaagtgcatgcacctggacggtatcgtcctggatggccttacgcacctgcccggtggatgacgaactgaaccatgccagcggtgcccgggacaggcgcccgatgatgcgaccctgcaagacactgcgcagtttgaggtcagcgaaatgtgtgatgacaagggccagcacgtagagcagggcctgggtgcagaaggccgccaccaacaggttcgcggtatgtacgagggcctcgtggtcgatatgggcgctcagcaggatggtgccgagcttcaccaaggctagataggggggccaaggcgacgacgcaggaggcgatcgataatccgcgccaccaggattcgtccccggatgggttgcataagcgatgagagggctctacccccggcgcggtgcttggcctgatagtcgtgggagctttcggcagatgcagtttcctgggctgccacggaggctggcggcgacggctgggacgggccaacgatggaggcaggatcccccgaggtggttctgctcacttcgtcagtcccgcccgctggaaatgtttgcgccccaccttgatgcccagccaaccaccgagaagtccaagcaggaacaccacgacggcccatccggcgaccagaccgggagtaaacagtgctcgcatcttgttggaataatcggcacccatttgcctggtgatcatggtgtagtactcgtcggcgttcacgaccatcggtatcagtggcacgaccacccagagggtgaatatcgcgtatccgagagacgcccggcgcgggtccaggcggacattgcgcccggcgttggtggtgaccagatcggcgacgaagccgagcacgagcccggcggggatcatccagatagcatgcccgggcgtcataccgagcccgacgagcagcccggtgatcgtcaaggcgcccattttcgggacccgtgccattgacagcatcacgatgatcccgcccagcagaataccgaggatccagccaacgaacataaacgccggcccggcgaaaccaatcatcccgcaggcgtagaaggcgacgaagaaaatcaccgcgaaaatggctacggtcaccagatcacgagtggtcaggcgtgatttcatgatttccctttcaaggtggcgatattgaccagaaagtccccacaccgggccatgagttccgggtcgtgggtaatgacgatgacaaccttcccggcggtggcaagttcaccgacgagatcggcgatcgacgcgagatgccggcgatcgacacccgaggttggttcgtcgaaaacgacgacctccttgtcttgcgcgatggtggccgcgaccacgaggcgttgggcctgcccacccgacaaagacaaggggtggcgatcacgttcgccggccaggtcaaggcgttccagaagtcccggtacgtcggcggcatctcgatgcggaagatccagcccgagggtgacttcacgttctaccgactcactgaaaagctgacggcgaacgtcctgcatcaccatcccgcaacatttctgacgcctgccgggggtccagggcactcccatgccgatgcgagcttcgggaggggatttttcgagcccgcacacgattcgggccaaagtcgacttccccgcgccattcgagccggtcagaatcgtcaccgccccgccaggcaggaacagagaatcgatgtcgagaatcgtcgagccggtacggtaagagaaggtgaggtgctcgatggtcagccctgccgggattttcgtgcagctgactgaggcgggatcggagcgcatgaacttgcctcggggcaccggagtaagcggagctggagcctgcggtggcgccggcaggtcgaccgagttgacgtcgagactgcgcaggccccgttctagcaagtccccctctgtcagcgcgaaaaggctgctgccgctcattcgctcaacgatctggccattggaaacacgatgcacgtcgtcaacgagtccgcggaacagatgcagccggtgctcagcgatcacgagggtcttgttggcagctttgagctcggtgacgagagcgcgaaaatcttcgatcccctcagccgagaggttcgaggttggttcatcgaaaagaagcaggtcgacatcagccaccagcgcgcaggcgcaggcgacccgctgaagttctcctcctgaaagagtgtcgaggtggcggtcgagcaggtgagagataccggttcgggaaaccgcacgggagacagcttcgcggatatcaaccggatcgaccccatagttctccagcccgaaggccagctcggtgcgcacgctggaggtgaagaactgagtgcggggattctggaaaatcatcgcggaggtgcggccgacattgtgcagttcgacactggccaggtcagtaccttggaccatgacgtggccgcgcaactttcccccgaagaattgggggacgagtccattcatcgtccgcaatagggtggatttccctgaccccgacgctcccaccagcagggtgagggtgcctggttggatcgtcatcgtgatgtcacgaagctgttctacgaactcccgctcgggggccgggccgtcggagaacggcgaggagtcggggtcgaacgaggggtagccgtagctgacgccgttgaggctgacgatgctcacacgatcacctcgctggcacgccacacaaccaacgcgaccaaaatcgtcagcacgagggcgtcgccgacgcgaaaacgactcgactgggtgttcgatcgggatttttgtgcaccgagtcctttgatgatggcggctgcggaaagctcgtcgacgatgcgggcagccgaggccaggaagggaatgacgacgtactcacccgtacgtatcgggtgacgcacagccgaccgcgccccagggttgaggccgcgcagggtcatggcctggacgattgctcgcagctcgcgtactgccatcgggaagaaccgaaccaccaccatgacgggcacataaatgacgcgcggagcatgcaattgggtgaggaccgcgccgacccgagtgacgtcgaggactttgatcgccgctactgccgcaccaaagactccggcgaaccgaaacatccagaaggcgatgaagaccaggaacgccgatactgtcgagcgccacagcactgggagtaggaagcagcagaaaatccacaccagcacgaagatcgtccagcttatccaggacttcgaccgggtagtcaagaccaagaacacccacatcactccaagactggtcatcacgaggactgttgatcctgctcccataagtaggacgttgagaacgatgacgtagagggcgagggtgcgtggatccaccgtgccgaagagctgccgagatcagcgagtgtggaccgccgaagcagtatcgaaacctatcccagcaaccgagcgactatgaggaacgcggtgagtggctccgggcagcgccagggtcgcctcatcatgtttcataaggtaaccctatctcataactgattactgttaacaaatacttcctctcccgctttgacccggagttggccatgacggcgccatatgagctccctgccaccacgtgaggcacgatggaagggccgacgaccaattaccgaagaacaggtgtgagcatgactgacgtggagaagtcctcgactcgcggtgagaggattctcgccgctgtggtcgccttcaccctctggatggccgtgatattcgcgattgtggcgatcttcgtcggctggcggtggtcgctgcggatgttcgtcggggtgctcctcatcggtatccccggagagatcgttatggagctcgtcggccggggaccgttgctgccgagcggcgcgtcgagaatacggcgttcccgtggttcgcggttactcctctcggcactcatcctcatcgcgtgggcgttcatcgttctcgcggcgattgcgctcatacagccctggtacggcgctaccggtgacatggcctgggtgatggtcgtagggatcgcggcgatcctcgtgcaggagggcatcgacacccgcaagaagaagtcctagtcttcgatcatctctcatgaaggacttgtcggctcctcgcatacaagggggtcgatagtggtggccggaacgtgcgggttcgatctcgccacaatcatggataccgccagccttggtgtccgtccctgccacaaagcatcacaaaagcattggtgtacacatcagcatcgctgctgcggttgatcgtgaggccacctgagaccattcagggcaggctcacccattcccttccgatttacacctcgtgcgacctcgcaccgcctacaatttcagagcaacgacgcctcatccccgccgccatagtcaggaaaacactgatgatgcccagggtccgcccgtgacgaagaagagctccctcgtcctggcgatggcgtccatcggtgccatcgctgttgggctgaccgggcgtgctcgtcagctcaccctcgccttcaactccgcgagttgggtcgtcgccgtcatcgcgctgagctatctcatccgctccgggcacagccagaaagcagcatggctggcccaaccaccgagggtgcccgaggcacagccgccaggcggttgacggtctcctcgacgtgcattctcacaccatcgcacggcgaacatccaccgatccgctgcccaagcacggctaccctggaactcagttgagtgagaggagacccgcgtgggcatcggaagcaacatcggcaaggcactgttggcccaagcccccgacatggcacccggcgcagctgtctcactactacgcagcatcctcggattcgctatcgacggcgcctcaggactgccgggagcacgtcaggctgccggcaagacgctcaccaagcacgagggcgatgttgagcaggcgatcagctccttagtcaatcagcacattgcgatggccggggcccaggggttcgtctccaacctcggtggcgtcatcactctggccgtgactatccccgccaatatctccggcgttgcgatcgtgcaagcccgcatggtggctgccatcgcccacctgcgcgggtacgatctcgacgaccagcgggtccgcaccgcgatcctcgccactctcatgggtcagcgcgaggtcgatagcctcatccacgaggagaagctaccgacgacaccgatgggcatcgctaccgctccggtcggtgacgccgatctcgaaaaggtcgtcgcccggaacctcgtcaatgtcctcatggggcaggtcgcgggcaagaagctgcctgtgttcgtctccaagcgcgttcctgtacttggcggcggagtcggtgccaccgctgacggattcaccacgtggagcgtggcccgctacgcccgtaagcaattccccacccgccgcccgcgcacctgagacccgcacgctcgggatacggccaggataattcggggcaggaatagtggcgtccgaccacagtgacgggatgtggccgggattcaacgacgcaaggatttcaccccacccagcccccatgcgtacccgacaacccctaggaaggcacaaacgacggcacacaccatggccgtggtagacactgtcggcgcactcccctcgacggcggccgtttttcctggatagccgccggggaggaatcgcaggagggtgttcgactgcgcgacgaccacaaccaggtagatcaggggaccgcacaatggcccgactcgccgcgacaccattcccgtgacgaacaatgcgataccggtacacagcacgcaagtcaccgagaaccctatgaatggcggccacggcagctgaaaccgtgcgggaatttgcggtaccaggacggaatcaccatcaggtatcaactcaacgggcaacgatcgcagtacccatcctatgagcaatggaagaccagctgcacagccgcatatccacagccccatccacgcatatccaaccgtgagggaccgaaccgatgtcctctcgacccaatccatggccgatgagacacaccacatgatggtggcacaacccaccagaatgatcagctcgggaccagtcacagggcgatcccacacgtctcccggcgccaccgacagactcgccttccacaggaagaaggccacgagcaaggccacaagcggcgcaatgacaagggcaatagcatggcgccccttcaggaaagtcgctacgcctctcatcggtgaagatcactggaggtcaatgaacacgtgcttaccgcatgatgatgcgccgtataccaatgacggaatgcggttacatccatgccgtcaaggccatttcgttccaaactcgtcgcatcatcatgctgaaatccagccagccgaagaatggtacgttccacggaatcgacgccattgagggccccatctgctgagatgtcaactccgaccctccggtctcacgcataaaagcacatgcgtcccggcctgaaaatgattgagccagcccctcacccgtcagatccgacatttgttgtctagagccatatgaggtcggtcggccgagatcaatcacacgttgcccctgtatgcttggtacccagactcagcaagcaggacgtcacgggaaaccaccgtttgcggcaggacagacaagacgcgttgagcgggtttcgcgtaggacgccgcgagactccgatgtgctggcgtgacgcatacccgcacgccttcgtgcgacgaacactcaaaggctagtggcgcatcacgaaacaacggcaccggcaagacgacgcccacggcagcaatgatgagcggtggggcgatcaaggccacacaaggcatcactcgacgccagcagaacctgtcggcacggaccctggaccaacgactggcggtgaggatacaggacaaggtgacgatgcagaagaagatggcgcgcatgaccacggccgcgaccgtgacggtgtgggtgccacccggttccgacattcccaaagaccatgcaaaggccaccgagccatgccccgtgttggcaaggagatttccgttgacgacgatcggcatttcgaccaggacgatacacacaacaggtaccaccagccacacgatggggtgggacaccatcgcggccacgaggtgagcaacggccaccaaagccgcgaatgacagcaggacgacgattaagtcggaggcttcggcgacggtcggagtcgcattgagccacgtcttagcgaccagcggggccgccacgatgaccgtcccgatgaggagggcagtcgtctgccgccagaaccagtgccagtggatgccaagaatggaccgcgccggagcaacccccacaaccatgtccgaaggtgccgtgcgtgccgctaggcccacccccatgaggccagccacgataccccacagcatactggactcccggagcgtgacggcgacatcctgcacttgccacaacccccaagcccatcgacctcgcaacgcaatgaagctgcacatggctcctccgaccgtcacgagaaccatgtgccatgacgtgaaggggaatgccatgcggtgaaaaccgcgcagcggacgtataccctgaagcgaggtgagcatcacgctgcgccccccgagaagagtgaggtatccagcctcagcatcgttggtattacggactgggtgccctcggccaacagattccagttcggaatacgagccctcgaagatcagctttccctcggacaggacgacgagttgcgacacgaagccctggagatcctcaagcaggtgagtcgacacaatgaccgtccgatcttcggcgagctcaccgaagagggatcgcaccccgatccttgatgccgggtcgaggcctaccgtcggctcatcaagcagtagtacagccggatcgccgacaatcgcacacgcgattccaagtcgttgacgcattccacccgaaagagactggacgcgctcatcggcacggtcaagaagcccaacacgatcgagggctgcacatgccctcgcacggcattcgctcggttcaacgcctcgcgcccaggccgcatattccacggcccgccggatgcggaagtgcgacgggagggaaaaccgctggggcaggaatccgaccaaaccacggatggtgtcgacgtcatcgctgacatcgacaccattcacccgaaagtggccggactccggttcacggagtgtcgcgagaatactgagaagtgtcgactttccggccccatttggaccgagcagcccccacaaaccagagccaaactcacaggaaatatcaacaaggctacgccgatggtggtaacggtgtgatacgtgctcgagttcaatcattcacttagccgtaacgtaacccgatttcgcggatgccatacgacgtcctttctgcagcagaaacatctccaatggaaaacccgctaccgtacccatactttcacttagagtaaggcagtaccaaccttgcggcaaattcggcggtacctaccgcgctcccacaattcttctcagaatcgggtcagtacagcattgccgacgccgggtccgaaaggatctccgcaacgtcgtggaggaatgtcgaaccctgctcaccgtcaataagacgatgatcgaacccgaggctcatcgtcgtcacccacctgggcacaacgcgctcgtcgtcaccggtcccgacgacccacggccgccgagcgagagcaccaagcacgaggatcgctgactctgtccggttgaccacgggagtgccggcatcaagcccgaacaccccgacgttcgtgatcgagaaggtaccgtcggcatagtcgggcgattgcagtttgtcctctttggcgatcgcaacgatccgggtgatctccgtcgccaactcaagcatcgtcatgtcctgggcgtcgcgcaccaccggcaccatgaggccgcgcggcgtggcggcggcaatgccgaggttgatgtggtcacggaagacgatctggtcggtggcgtcatcccatgcggcgttgatgatgggggtgcgccccatcgccaggcacaccgccttgcaccacaccgtcagcggggagacacgcaggcccttgaaacgacggtcggcacgcagccggttgaccagctccatcgtcggggtgacgtcgcaggtgaggaaggccgtcacgagggccttcgtatccaaggactccttcacggccttcgctgtgaccttgcgcaccccacgcactggcaccttgcgggtgtggccgtcgggctcggtcggggcgccaccgaggagacgccgagacatcaccgacaggtttgccagctcggcgtcaccacaagaagcgccggcgtccccggctgcagcagcgccatcatgagcggccgctttgacgtcactcctcgtcactgcaccctgcggaccggtgccggtcacctgggacaggtcgatgccgaggtctgctgccaatcgtcgggccggcggcttggcaaggatgtgcgcggtgcggtccatgcgcggtgggtcttgacgagaagccgactcggttagacgctgctccggtttcgcctcggcgtcgtgttgaggttccgaaaccgattgctcaggatgagtgtct

SEQ ID NO: 81 - DNA, 2055 bp, Propionibacterium acnes
ctcgtcgagacggatgacctcggtagcctgcagcgcccctaacacaactcgctgcgacgcctcaccccatgctttgaacacctcgtggccggcctccgggtccaccgcgatgttccactcgctcgtcggcccggtgttgccacgatgattgatcgccccacccatgacgtgcagcccccgcaacaaccgcggcaattccggttcttcccgcagcgccagcgcgaggttcgtcaacggcccggtgacgatacccaccaacttccccgggtattggcgcgcgagatcaacccacagttgtgccccgctacgcgaatccgggtgacgcccgcactcccttagcacagcgtgccccaacccgtgcggcccgtgggtctcctcggcggtcatgagaggctcgacgagcggaacgtccgcccctcgggcaaccggcacgtccattccgagcagatcagtcaacccaagcgcgtttcgcagtacgtcgtcctgccccacgttgccggcagtcgtcaccaccccgacggtctcaacgtcgtcacggcaggccaggtaggccagagcgaaggcgtcgtcgatacccggatcgcagtccaataagacgggcagggagcgcgtagaggtcggcatgtcgccacactaaggcttcgaccgttgaggcgtcaccctccgatgagtccaccaaacttgtagcgggattcatgaaaaacgccggggaacagaccgtgctccatccccgcgatgatgaactcaattttaagatcgagattcccgcgctcccccatgtcctgcattccgaatagttcgggcagctctccagcgatcctcacaaatttgtccaatccggtgcgaccttcttcatcacaggtcatgtacggctggaccgacatgtacgtctccaaggccgtgtcccccgcgaaatccagggcgaaggctgccccttccttgcccccggggataccgagtgcggccaacctctcaacgatcgccgtgattcgcggcagagctactccgaaggcttcaggccgggtgacgataacggcggccgcctccgaatagcggacacacatctgccactgccgatccacgacatcgcgcagcacgtcctgccaggtgcacaactgcggatccggttcgatgtcggcagctatcgcgctgatcgcggcaagctgcaactcctgacgggaactgaactcccggtacaaggcagtggccttcactccaaggcgctcagcaaccgctcgaagagtgaaactgccaattccttcagctagagtcgcgtcaatgacctgacgtcgtgtgaacgcaggtttacgccccggccgttttctcatcacggccgacccacgagcgaccaccccacagcccgttcccgggcatgccacagatcggcatacaggccgctgctggcaatgaggtcgtcatgggttcccacttgacaaaccctaccagtgcgatcgacgacgactatctgatctgcggaacgaatggtgtcgagcttgtgggcgataacgacaattgtcgatgtctgtcgcagctgggtcacagcggcctcgacatgggcctcgttctccggatccaaggccgaggtggcctcgtcgaaaagcagaatcggggcgcgtttgagcaaggcccgagctaccgacacccgctgacgttcgccacccgaaagccgacgacccccttctccgacgctggcatcccagccgcccggaagacgatcagcaatctcgtcgacaccggccagggctccggcctgacgcacgtgctcatcggtagcgtccgggcaaccgatgcggatattttccgtcagggtggagtcatagaggtacacatcctgaaacaccatggcaagctgactcatgagctgttcggtagtctgatcgcggacatcgaccccaccaactcgcaccgttccggaattagcatcccagaacctggcaatgagccggaacagggtggacttgccagcgcccgaggggccgacgatagccatcagtccgccggccggaacagtgaacgagacatcgtggaggaccgggcgagccggatcgtagccga

SEQ ID NO: 82 - DNA, 6363 bp, Propionibacterium acnes; identical to SEQ ID NO: 29

SEQ ID NO: 83 - DNA, 6363 bp, Propionibacterium acnes
gtgttgtggactctcggggtcagtctgtccgctcacttgagatggcttaacatttctgaccgacgccgaagtctacgaacgctgcgaaacgccaaccgacgcctttgcaaccaagccttcttcatcaagatctacatcgacgaagacgaccaactccgcgtcgagaacaaccgacctttcgaaatgctcctcgaccctcagatcaacgccaacgccctcacctgggcccagaacggcaacaaggcccgaatcgaaactaaggggttcgagccttgtgcgtggggttacttagacgttcattttgatacaaggatctgggtgggtgcacggaggggctaggtgggtgcattgcatcctgacaggagcgccgggtgagttctggttgactaccagcagcgtgttcggtatgctagaggatagttacgcgacagcgtccgttccaatttctgggagtgtgttaattccgatggtgctgtgatctccgttcggctacgccgagaagcgtccaaatgtttcgacggttttggggatcaatatgtctgctatcgaggtaatcaatctttctttttcattttccgctcagccactcttggataacgtttcattcagcgttggcgatagcgagcgcgcagtacttgtggggcctaatggctctggcaaaaccactctcctgcgcctgatacgaggagagctaaccccggatcgaggacatatcgccatcagtgatgcaggagatgcaggttcttgtcgcttcccttatgttcgtgacgccactggcacagttcaggactatctggacgacgtgttggctggcccatgggagttgctcactcgcttcgaccacgtgacgaagcaactatcggctgcccaaagttcagcgagtctcgctaaagagtacgatcacatactcaccagtcttactctggccgacgtatggtcgctcgaagctcgaatcgatgaagtgttagccggtttaggtctaggccagctgaccggacgcggtcgacagcgcgcactcggctcactctcccctggccaggcagtgcggctcgaactggcaggcatcattatggtcagaccagtaactctggtcttggatgaacccaccaatcatcttgatgacgaagccgtaggctttctgatccagcaaataacagattggccggggccagtgctcatggccagtcataatcgtgcgtttattgaagagacagccacggtcatctatgacctcgatattgccccgtggcaggctttggccacagctgaaggagaggctgtgtctggcgtgtaccggtgcactggcgcctatagtgattatcttggcgccaaacaacacgcccgcatggagcatcaaaagcttcacgccacccagcaatctgaaaaacgcgcgattcgaagtcatcgccgtcgtagcgaagatatcgctcgtggtggagtgaaattagcgaaggcgcagggcatggcacgtaagttcttctctgaccgggcagaaaagaccgcgctgcgacgcacgcgtaacgacgatcaacgcttacacgatcttgctgaacatgaggtgcgaaaaccccgcaactaccaacttaagctcaaccttccaccagtcggctcgcgtggcgggttagccgtcacggcacgaagcgccttcattccaggcaggcttctcccaatcacgttcgaccttgccacgggggaacatttaatactgactggcccgaatggagcggggaaaaccacgctcttgaattggcttgctagtgggaaaacaacaatcgaccctagatccgaagccagcggcactatctctgtcagcgggcggcttgcttacgtcccacagcgcctaccacgcacaggagattcctactttcacccagaacattggaaagacgggatcagagaacttggcacgggaatactccacccatccatgtgggccaccccagtcggccaactttcagatggaaaccagcgtcgagcccagatcgcgttagccgtggcgcagaaacccgagattcttgtcattgacgaaccaaccaactacctcgacctcgccacgcttgaagaactagaggacgcgctacgccaatggaacggcacactcatcatcgccagtcacgaccgctggcttatcaaccactggcagggaacacaaatcgaattatgccccacagatccagcgcccggatcaccgaatcccctcttactcgttaagagccggttcgagccgtggtagtgccgtccttgagtgtgagtttgatagcgccgtcgtggttgacggtggtgtgatcgacgagggtgttccaggcttggtcggagtattcgagtggtggttgggtggcaaggtagtcgcgtacttcgattgcttgtgctcggcggtggcgcagatcgtcgatctggtcgctgatccgttgatgctcggcctcaagttggtggtgccgatcttcaagctcgtggtaacggcggtcgtagtcgtcagggtcgtgggcggtcgtggctgcggggtgatgagttggttcatcagcgtgatggtttcttcgatccgctcccccagcgtggcctgcttggtttcgagctcgcgggtgtcgtagacggtttcgtcgagcaggcgcatggtgtcatcgagcacgtcgttgccggtgacccgcttagccagggctgcgacgaaggcgtctttgatctggtcttcggtgacgtggggtgtcgcgcagtgatgatccttgttgtatttgttgttgcagcgccagatgtagcggcggtatttgctggtggagtgccagactttccgcccaaacctcccgccgcaatcggagcaggtgatcgtgttggcgaaggggtgggtgttggaggtgcctttgcctgcgcggcgggcgagttctgcttggacggtgtcccaggtgacgggatcaatgatgggttcgtggttgctggtgacgtagtactggggtacttcgccttcgttgattttcatggtttggttaggaagtcggtggtgaagctcttttgcagcagcgcgtcgcctttgtatttctcgttggcaaggatcgaccgcacagtggagggcgaccagatttgtttgccacgcggggtggggatgccatcggatgtgaattctttggcgatggtttgtggggttgcgccttcgaggaagcgggcataaatacgacggacggttggtgcttgggtttcgtcgatggcgaggttgccgtcttcgcctttcttgtagccgagcagggacgcgtaggacaccatgattttcccgtcggcgaagcgtttacggtggtcccaggtgacattctcggaaatggagcgggattcttcttgggtgaggctggacatgatggtgatgagtagttcgcctttggaatcgagtgtccagatgttttctttttcgaagtagacctctacgcctttgtctttgagctggcggacgtggatgagggtgtcgacggtgttgcgggcgaaccgggacacgctcttggtgaggatcaaatcgatttttccggcgagggtgtcggcgatcatggttttgaagccttcacggtgtttggtgctggtgccagtgatgccttcgtcggcgtacatgcctgcgaattcccactctgtgcgggattggatgtggctcgtgtagtagtcgatttgtgcctcgtaggaggaggcttgttcttccatctcggtggatacccgcgcgtaggccgctaccctgcgccgacgccgagtaccctgcaccgtggtgtgtccgggtatttttgtggctgggatcgcggtgacacgcttgttccgaatctgcttggtggtcatatcgcactttcctcgtccaggctcaccgccactggcacttcgccgctaatggtgtggatggtgagcgtacgatcgggattgacaacgattttcacgaggcgcgtcagcgcatactcgtcgtcccagtcgtcgaggccaagcacgcgggtgcagatctgggtgagatgggtttctcggatttgtggtgcctggcagggattgcctttacctttggtggcggtttcgcaccaccaaaacttgtaggacgtgtggcggcgtgtcttggtgcggcggtgataaaacctgctacagacagagcattcaatccgagaggtgagcccggtcgttctagctgacggcgtggctccacgtccgagatgtctgcgccgggcgagctcggcctggacggcgccgaacgtggtctggtcgatgatgggcgggtgggattcgtcgacgaggtagcgtggcagctcgccggtgttggtatggcagttcaattctgcaacgtttggccggtaatacttttgcaggattacgcggccggtgtagatttcattttcgagccatttgcggatcgtcttaccgcgaaacttggctccccgcctaggcttgaccccttcagcattcaactgactgatgatcttggcttcagtctcgatgatagccaagtcactacccacgtattggtagccgtagggttggcgcgaatgcatgagcccgtcggcgtatttcttccttatcccccatttaacattcttcgacatggatcgagattcctcctgcgcaaacgatgccagcagggtcagcaggagttcaccgtcagcggtcgcggtatcgatctgttcacgctcgaaacgcactgagacgccgaggattttgagttcgcggacggcatcgagcaggtcgacggtgttgcgagtcagcctggatatcgacttcgtcaaaatcatgtcgatgtcgccggagcgggcggcggccatcatggtctggaacccctctcgacggacggtactggtgccggtgatgccttcgtcgatgaacacgcctgcatagtcccaaccaggggtggattgaatcagatgagagtagtacgacacctgggcggcaatcgaagatagctggcgttcgtgctcggtcgatacccgcgcataccctgctactcgtagccgacgtggcgtggcgggtctaggtgggataactcgaaaactacgcgaggtcactccctgcttctctttcttctatggcgacaggtgttttggttgtatccatctacgctctaaacctgagtcttatccagtcgaacctgcagcaacaatgcccccactggcgcggttgcttcatgcccgatccgcgtaaggatcacgtggctttcgtttggggtgagtgcgccggtttcggtgagccgatcaataaaggcgacctggcgggcaagatcgacttcggcattgaacatggcacccgtcacggtctgccacctcgggtgctgaagcggtgcctgatatagcaggcatgcgagcaatacttacggtgcttgtttccgtaggcctcgaagctctcaccgcaagcaacgcaggtgaaggtgtatattgcccgccggttgagccgttcggggtgggcgtgctaccacgacaaacgacacacatccgaacagaacctttgccccgccaccgcagcttcaaaatgcccattacagtgttcgcatgccttagcaggctcaacatcaaccgccggatcgatgttgatgtcagctctgcgacagatcgacttcaccgtattgcgcgacatgcccaatctggtggcgatctgcccatacgatgcgcctcggcatcgcagctccacaactcgctcacgggtaatctcacgtgccatgacgcgctcctgctcaatagaaataaggtctctactgacagggcttcgacccaccccgatttataaccaccactgtcctggtgcgatgggaacaaaaatggccccgccaccacctcatgtagtgaggcagcgacggggcgaaacaggacagttttcatgagtcttggtttagtggcggagtttttcgttgacccggcgctggacggcgtcgtagttggatccgagtctgcgtcggcgttcgttgccgttgccgtattcgccgcggatgaccgcgtcagcgagcgcgtcaatgttcggtgccggcttcggtgtgggtgcgggtttcggtgccggcgcgggtgcgggcgtgttgccggtcatgtggtcgtaccagtactgggcgcgagccatataggcggcgtgctgagtaccggccagcgatgctgggcattcggtggctgagaagtttttgtgcccgaacacgttcttaccccaggtagggcggccgagcttgtaataccgacagatcgcggccaccaaatgtgcgccgttgtcgaggcaggcgtcagagattttccatgggttagaagaggcgtcggcgtgctcgataccaatgctggtggtattggctgcccagtttccggcgtgccaggcggtgtcgcggtcccacacgagctgcccgatccgcccggaggtttctacctggtagtgggcggaggcgggccgggtctgccacac

SEQ ID NO: 84 - DNA, 6363 bp, Propionibacterium acnes; identical to SEQ ID NO: 83

SEQ ID NO: 85 - DNA, 6363 bp, Propionibacterium acnes; identical to SEQ ID NO: 83

SEQ ID NO: 86 - DNA, 6363 bp, Propionibacterium acnes; identical to SEQ ID NO: 83

SEQ ID NO: 87 - DNA, 6363 bp, Propionibacterium acnes; identical to SEQ ID NO: 83

SEQ ID NO: 88 - DNA, 6363 bp, Propionibacterium acnes; identical to SEQ ID NO: 83

SEQ ID NO: 89 - DNA, 6363 bp, Propionibacterium acnes; identical to SEQ ID NO: 83

SEQ ID NO: 90 - DNA, 6363 bp, Propionibacterium acnes; identical to SEQ ID NO: 83

SEQ ID NO: 91 - DNA, 6363 bp, Propionibacterium acnes; identical to SEQ ID NO: 83

SEQ ID NO: 92 - DNA, 6363 bp, Propionibacterium acnes; identical to SEQ ID NO: 83

SEQ ID NO: 93 - DNA, 6363 bp, Propionibacterium acnes
gtgttgtggactctcggggtcagtctgtccgctcacttgagatggcttaacatttctgaccgacgccgaagtctacgaacgctgcgaaacgccaaccgacgcctttgcaaccaagccttcttcatcaagatctacatcgacgaagacgaccaactccgcgtcgagaacaaccgacctttcgaaatgctcctcgaccctcagatcaacgccaacgccctcacctgggcccagaacggcaacaaggcccgaatcgaaactaaggggttcgagccttgtgcgtggggttacttagacgttcattttgatacaaggatctgggtgggtgcacggaggggctaggtgggtgcattgcatcctgacaggagcgccgggtgagttctggttgactaccagcagcgtgttcggtatgctagaggatagttacgcgacagcgtccgttccaatttctgggagtgtgttaattccgatggtgctgtgatctccgttcggctacgccgagaagcgtccaaatgtttcgacggttttggggatcaatatgtctgctatcgaggtaatcaatctttctttttcattttccgctcagccactcttggataacgtttcattcagcgttggcgatagcgagcgcgcagtacttgtggggcctaatggctctggcaaaaccactctcctgcgcctgatacgaggagagctaaccccggatcgaggacatatcgccatcagtgatgcaggagatgcaggttcttgtcgcttcccttatgttcgtgacgccactggcacagttcaggactatctggacgacgtgttggctggcccatgggagttgctcactcgcttcgaccacgtgacgaagcaactatcggctgcccaaagttcagcgagtctcgctaaagagtacgatcacatactcaccagtcttactctggccgacgtatggtcgctcgaagctcgaatcgatgaagtgttagccggtttaggtctaggccagctgaccggacgcggtcgacagcgcgcactcggctcactctcccctggccaggcagtgcggctcgaactggcaggcatcattatggtcagaccagtaactctggtcttggatgaacccaccaatcatcttgatgacgaagccgtaggctttctgatccagcaaataacagattggccggggccagtgctcatggccagtcataatcgtgcgtttattgaagagacagccacggtcatctatgacctcgatattgccccgtggcaggctttggccacagctgaaggagaggctgtgtctggcgtgtaccggtgcactggcgcctatagtgattatcttggcgccaaacaacacgcccgcatggagcatcaaaagcttcacgccacccagcaatctgaaaaacgcgcgattcgaagtcatcgccgtcgtagcgaagatatcgctcgtggtggagtgaaattagcgaaggcgcagggcatggcacgtaagttcttctctgaccgggcagaaaagaccgcgctgcgacgcacgcgtaacgacgatcaacgcttacacgatcttgctgaacatgaggtgcgaaaaccccgcaactaccaacttaagctcaaccttccaccagtcggctcgcgtggcgggttagccgtcacggcacgaagcgccttcattccaggcaggcttctcccaatcacgttcgaccttgccacgggggaacatttaatactgactggcccgaatggagcggggaaaaccacgctcttgaattggcttgctagtgggaaaacaacaatcgaccctagatccgaagccagcggcactatctctgtcagcgggcggcttgcttacgtcccacagcgcctaccacgcacaggagattcctactttcacccagaacattggaaagacgggatcagagaacttggcacgggaatactccacccatccatgtgggccaccccagtcggccaactttcagatggaaaccagcgtcgagcccagatcgcgttagccgtggcgcagaaacccgagattcttgtcattgacgaaccaaccaactacctcgacctcgccacgcttgaagaactagaggacgcgctacgccaatggaacggcacactcatcatcgccagtcacgaccgctggcttatcaaccactggcagggaacacaaatcgaattatgccccacagatccagcgcccggatcaccgaatcccctcttactcgttaagagccggttcgagccgtggtagtgccgtccttgagtgtgagtttgatagcgccgtcgtggttgacggtggtgtgatcgacgagggtgttccaggcttggtcggagtattcgagtggtggttgggtggcaaggtagtcgcgtacttcgattgcttgtgctcggcggtggcgcagatcgtcgatctggtcgctgatccgttgatgctcggcctcaagttggtggtgccgatcttcaagctcgtggtaacggcggtcgtagtcgtcagggtcgtgggcggtcgtggctgcggggtgatgagttggttcatcagcgtgatggtttcttcgatccgctcccccagcgtggcctgcttggtttcgagctcgcgggtgtcgtagacggtttcgtcgagcaggcgcatggtgtcatcgagcacgtcgttgccggtgacccgcttagccagggctgcgacgaaggcgtctttgatctggtcttcggtgacgtggggtgtcgcgcagtgatgatccttgttgtatttgttgttgcagcgccagatgtagcggcggtatttgctggtggagtgccagactttccgcccaaacctcccgccgcaatcggagcaggtgatcgtgttggcgaaggggtgggtgttggaggtgcctttgcctgcgcggcgggcgagttctgcttggacggtgtcccaggtgacgggatcaatgatgggttcgtggttgctggtgacgtagtactggggtacttcgccttcgttgattttcatggtttggttaggaagtcggtggtgaagctcttttgcagcagcgcgtcgcctttgtatttctcgttggcaaggatcgaccgcacagtggagggcgaccagatttgtttgccacgcggggtggggatgccatcggatgtgaattctttggcgatggtttgtggggttgcgccttcgaggaagcgggcataaatacgacggacggttggtgcttgggtttcgtcgatggcgaggttgccgtcttcgcctttcttgtagccgagcagggacgcgtaggacaccatgattttcccgtcggcgaagcgtttacggtggtcccaggtgacattctcggaaatggagcgggattcttcttgggtgaggctggacatgatggtgatgagtagttcgcctttggaatcgagtgtccagatgttttctttttcgaagtagacctctacgcctttgtctttgagctggcggacgtggatgagggtgtcgacggtgttgcgggcgaaccgggacacgctcttggtgaggatcaaatcgatttttccggcgagggtgtcggcgatcatggttttgaagccttcacggtgtttggtgctggtgccagtgatgccttcgtcggcgtacatgcctgcgaattcccactctgtgcgggattggatgtggctcgtgtagtagtcgatttgtgcctcgtaggaggaggcttgttcttccatctcggtggatacccgcgcgtaggccgctaccctgcgccgacgccgagtaccctgcaccgtggtgtgtccgggtatttttgtggctgggatcgcggtgacacgcttgttccgaatctgcttggtggtcatatcgcactttcctcgtccaggctcaccgccactggcacttcgccgctaatggtgtggatggtgagcgtacgatcgggattgacaacgattttcacgaggcgcgtcagcgcatactcgtcgtcccagtcgtcgaggccaagcacgcgggtgcagatctgggtgagatgggtttctcggatttgtggtgcctggcagggattgcctttacctttggtggcggtttcgcaccaccaaaacttgtaggacgtgtggcggcgtgtcttggtgcggcggtgataaaacctgctacagacagagcattcaatccgagaggtgagcccggtcgttctagctgacggcgtggctccacgtccgagatgtctgcgccgggcgagctcggcctggacggcgccgaacgtggtctggtcgatgatgggcgggtgggattcgtcgacgaggtagcgtggcagctcgccggtgttggtatggcagttcaattctgcaacgtttggccggtaatacttttgcaggattacgcggccggtgtagatttcattttcgagccatttgcggatcgtcttaccgcgaaacttggctccccgcctaggcttgaccccttcagcattcaactgactgatgatcttggcttcagtctcgatgatagccaagtcactacccacgtattggtagccgtagggttggcgcgaatgcatgagcccgtcggcgtatttcttccttatcccccatttaacattcttcgacatggatcgagattcctcctgcgcaaacgatgccagcagggtcagcaggagttcaccgtcagcggtcgcggtatcgatctgttcacgctcgaaacgcactgagacgccgaggattttgagttcgcggacggcatcgagcaggtcgacggtgttgcgagtcagcctggatatcgacttcgtcaaaatcatgtcgatgtcgccggagcgggcggcggccatcatggtctggaacccctctcgacggacggtactggtgccggtgatgccttcgtcgatgaacacgcctgcatagtcccaaccaggggtggattgaatcagatgagagtagtacgacacctgggcggcaatcgaagatagctggcgttcgtgctcggtcgatacccgcgcataccctgctactcgtagccgacgtggcgtggcggggctaggtgggataactcgaaaactacgcgaggtcactccctgcttctctttcttctatggcgacaggtgttttggttgtatccatctacgctctaaacctgagtcttatccagtcgaacctgcagcaacaatgcccccactggcgcggttgcttcatgcccgatccgcgtaaggatcacgtggctttcgtttggggtgagtgcgccggtttcggtgagccgatcaataaaggcgacctggcgggcaagatcgacttcggcattgaacatggcacccgtcacggtctgccacctcgggtgctgaagcggtgcctgatatagcaggcatgcgagcaatacttacggtgcttgtttccgtaggcctcgaagctctcaccgcaagcaacgcaggtgaaggtgtatattgcccgccggttgagccgttcggggtgggcgtgctaccacgacaaacgacacacatccgaacagaacctttgccccgccaccgcagcttcaaaatgcccattacagtgttcgcatgccttagcaggctcaacatcaaccgccggatcgatgttgatgtcagctctgcgacagatcgacttcaccgtattgcgcgacatgcccaatctggtggcgatctgcccatacgatgcgcctcggcatcgcagctccacaactcgctcacgggtaatctcacgtgccatgacgcgctcctgctcaatagaaataaggtctctactgacagggcttcgacccaccccgatttataaccaccactgtcctggtgcgatgggaacaaaaatggccccgccaccacctcatgtagtgaggcagcgacggggcgaaacaggacagttttcatgagtcttggtttagtggcggagtttttcgttgacccggcgctggacggcgtcgtagttggatccgagtctgcgtcggcgttcgttgccgttgccgtattcgccgcggatgaccgcgtcagcgagcgcgtcaatgttcggtgccggcttcggtgtgggtgcgggtttcggtgccggcgcgggtgcgggcgtgttgccggtcatgtggtcgtaccagtactgggcgcgagccatataggcggcgtgctgagtaccggccagcgatgctgggcattcggtggctgagaagtttttgtgcccgaacacgttcttaccccaggtagggcggccgagcttgtaataccgacagatcgcggccaccaaatgtgcgccgttgtcgaggcaggcgtcagagattttccatgggttagaagaggcgtcggcgtgctcgataccaatgctggtggtattggctgcccagtttccggcgtgccaggcggtgtcgcggtcccacacgagctgcccgatccgcccggaggtttctacctggtagtgggcggaggcgggccgggtctgccacac

SEQ ID NO: 94 - DNA, 6363 bp, Propionibacterium acnes
gtgttgtggactctcggggtcagtctgtccgctcacttgagatggcttaacatttctgaccgacgccgaagtctacgaacgctgcgaaacgccaaccgacgcctttgcaaccaagccttcttcatcaagatctacatcgacgaagacgaccaactccgcgtcgagaacaaccgacctttcgaaatgctcctcgaccctcagatcaacgccaacgccctcacctgggcccagaacggcaacaaggcccgaatcgaaactaaggggttcgagccttgtgcgtggggttacttagacgttcattttgatacaaggatctgggtgggtgcacggaggggctaggtgggtgcattgcatcctgacaggagcgccgggtgagttctggttgactaccagcagcgtgttcggtatgctagaggatagttacgcgacagcgtccgttccaatttctgggagtgtgttaattccgatggtgctgtgatctccgttcggctacgccgagaagcgtccaaatgtttcgacggttttggggatcaatatgtctgctatcgaggtaatcaatctttctttttcattttccgctcagccactcttggataacgtttcattcagcgttggcgatagcgagcgcgcagtacttgtggggcctaatggctctggcaaaaccactctcctgcgcctgatacgaggagagctaaccccggatcgaggacatatcgccatcagtgatgcaggagatgcaggttcttgtcgcttcccttatgttcgtgacgccactggcacagttcaggactatctggacgacgtgttggctggcccatgggagttgctcactcgcttcgaccacgtgacgaagcaactatcggctgcccaaagttcagcgagtctcgctaaagagtacgatcacatactcaccagtcttactctggccgacgtatggtcgctcgaagctcgaatcgatgaagtgttagccggtttaggtctaggccagctgaccggacgcggtcgacagcgcgcactcggctcactctcccctggccaggcagtgcggctcgaactggcaggcatcattatggtcagaccagtaactctggtcttggatgaacccaccaatcatcttgatgacgaagccgtaggctttctgatccagcaaataacagattggccggggccagtgctcatggccagtcataatcgtgcgtttattgaagagacagccacggtcatctatgacctcgatattgccccgtggcaggctttggccacagctgaaggagaggctgtgtctggcgtgtaccggtgcactggcgcctatagtgattatcttggcgccaaacaacacgcccgcatggagcatcaaaagcttcacgccacccagcaatctgaaaaacgcgcgattcgaagtcatcgccgtcgtagcgaagatatcgctcgtggtggagtgaaattagcgaaggcgcagggcatggcacgtaagttcttctctgaccgggcagaaaagaccgcgctgcgacgcacgcgtaacgacgatcaacgcttacacgatcttgctgaacatgaggtgcgaaaaccccgcaactaccaacttaagctcaaccttccaccagtcggctcgcgtggcgggttagccgtcacggcacgaagcgccttcattccaggcaggcttctcccaatcacgttcgaccttgccacgggggaacatttaatactgactggcccgaatggagcggggaaaaccacgctcttgaattggcttgctagtgggaaaacaacaatcgaccctagatccgaagccagcggcactatctctgtcagcgggcggcttgcttacgtcccacagcgcctaccacgcacaggagattcctactttcacccagaacattggaaagacgggatcagagaacttggcacgggaatactccacccatccatgtgggccaccccagtcggccaactttcagatggaaaccagcgtcgagcccagatcgcgttagccgtggcgcagaaacccgagattcttgtcattgacgaaccaaccaactacctcgacctcgccacgcttgaagaactagaggacgcgctacgccaatggaacggcacactcatcatcgccagtcacgaccgctggcttatcaaccactggcagggaacacaaatcgaattatgccccacagatccagcgcccggatcaccgaatcccctcttactcgttaagagccggttcgagccgtggtagtgccgtccttgagtgtgagtttgatagcgccgtcgtggttgacggtggtgtgatcgacgagggtgttccaggcttggtcggagtattcgagtggtggttgggtggcaaggtagtcgcgtacttcgattgcttgtgctcggcggtggcgcagatcgtcgatctggtcgctgatccgttgatgctcggcctcaagttggtggtgccgatcttcaagctcgtggtaacggcgggcgtagtcgtcagggtcgtgggcggtcgtggctgcggggtgatgagttggttcatcagcgtgatggtttcttcgatccgctcccccagcgtggcctgcttggtttcgagctcgcgggtgtcgtagacggtttcgtcgagcaggcgcatggtgtcatcgagcacgtcgttgccggtgacccgcttagccagggctgcgacgaaggcgtctttgatctggtcttcggtgacgtggggtgtcgcgcagtgatgatccttgttgtatttgttgttgcagcgccagatgtagcggcggtatttgctggtggagtgccagactttccgcccaaacctcccgccgcaatcggagcaggtgatcgtgttggcgaaggggtgggtgttggaggtgcctttgcctgcgcggcgggcgagttctgcttggacggtgtcccaggtgacgggatcaatgatgggttcgtggttgctggtgacgtagtactggggtacttcgccttcgttgattttcatggtttggttaggaagtcggtggtgaagctcttttgcagcagcgcgtcgcctttgtatttctcgttggcaaggatcgaccgcacagtggagggcgaccagatttgtttgccacgcggggtggggatgccatcggatgtgaattctttggcgatggtttgtggggttgcgccttcgaggaagcgggcataaatacgacggacggttggtgcttgggtttcgtcgatggcgaggttgccgtcttcgcctttcttgtagccgagcagggacgcgtaggacaccatgattttcccgtcggcgaagcgtttacggtggtcccaggtgacattctcggaaatggagcgggattcttcttgggtgaggctggacatgatggtgatgagtagttcgcctttggaatcgagtgtccagatgttttctttttcgaagtagacctctacgcctttgtctttgagctggcggacgtggatgagggtgtcgacggtgttgcgggcgaaccgggacacgctcttggtgaggatcaaatcgatttttccggcgagggtgtcggcgatcatggttttgaagccttcacggtgtttggtgctggtgccagtgatgccttcgtcggcgtacatgcctgcgaattcccactctgtgcgggattggatgtggctcgtgtagtagtcgatttgtgcctcgtaggaggaggcttgttcttccatctcggtggatacccgcgcgtaggccgctaccctgcgccgacgccgagtaccctgcaccgtggtgtgtccgggtatttttgtggctgggatcgcggtgacacgcttgttccgaatctgcttggtggtcatatcgcactttcctcgtccaggctcaccgccactggcacttcgccgctaatggtgtggatggtgagcgtacgatcgggattgacaacgattttcacgaggcgcgtcagcgcatactcgtcgtcccagtcgtcgaggccaagcacgcgggtgcagatctgggtgagatgggtttctcggatttgtggtgcctggcagggattgcctttacctttggtggcggtttcgcaccaccaaaacttgtaggacgtgtggcggcgtgtcttggtgcggcggtgataaaacctgctacagacagagcattcaatccgagaggtgagcccggtcgttctagctgacggcgtggctccacgtccgagatgtctgcgccgggcgagctcggcctggacggcgccgaacgtggtctggtcgatgatgggcgggtgggattcgtcgacgaggtagcgtggcagctcgccggtgttggtatggcagttcaattctgcaacgtttggccggtaatacttttgcaggattacgcggccggtgtagatttcattttcgagccatttgcggatcgtcttaccgcgaaacttggctccccgcctaggcttgaccccttcagcattcaactgactgatgatcttggcttcagtctcgatgatagccaagtcactacccacgtattggtagccgtagggttggcgcgaatgcatgagcccgtcggcgtatttcttccttatcccccatttaacattcttcgacatggatcgagattcctcctgcgcaaacgatgccagcagggtcagcaggagttcaccgtcagcggtcgcggtatcgatctgttcacgctcgaaacgcactgagacgccgaggattttgagttcgcggacggcatcgagcaggtcgacggtgttgcgagtcagcctggatatcgacttcgtcaaaatcatgtcgatgtcgccggagcgggcggcggccatcatggtctggaacccctctcgacggacggtactggtgccggtgatgccttcgtcgatgaacacgcctgcatagtcccaaccaggggtggattgaatcagatgagagtagtacgacacctgggcggcaatcgaagatagctggcgttcgtgctcggtcgatacccgcgcataccctgctactcgtagccgacgtggcgtggcgggtctaggtgggataactcgaaaactacgcgaggtcactccctgcttctctttcttctatggcgacaggtgttttggttgtatccatctacgctctaaacctgagtcttatccagtcgaacctgcagcaacaatgcccccactggcgcggttgcttcatgcccgatccgcgtaaggatcacgtggctttcgtttggggtgagtgcgccggtttcggtgagccgatcaataaaggcgacctggcgggcaagatcgacttcggcattgaacatggcacccgtcacggtctgccacctcgggtgctgaagcggtgcctgatatagcaggcatgcgagcaatacttacggtgcttgtttccgtaggcctcgaagctctcaccgcaagcaacgcaggtgaaggtgtatattgcccgccggttgagccgttcggggtgggcgtgctaccacgacaaacgacacacatccgaacagaacctttgccccgccaccgcagcttcaaaatgcccattacagtgttcgcatgccttagcaggctcaacatcaaccgccggatcgatgttgatgtcagctctgcgacagatcgacttcaccgtattgcgcgacatgcccaatctggtggcgatctgcccatacgatgcgcctcggcatcgcagctccacaactcgctcacgggtaatctcacgtgccatgacgcgctcctgctcaatagaaataaggtctctactgacagggcttcgacccaccccgatttataaccaccactgtcctggtgcgatgggaacaaaaatggccccgccaccacctcatgtagtgaggcagcgacggggcgaaacaggacagttttcatgagtcttggtttagtggcggagtttttcgttgacccggcgctggacggcgtcgtagttggatccgagtctgcgtcggcgttcgttgccgttgccgtattcgccgcggatgaccgcgtcagcgagcgcgtcaatgttcggtgccggcttcggtgtgggtgcgggtttcggtgccggcgcgggtgcgggcgtgttgccggtcatgtggtcgtaccagtactgggcgcgagccatataggcggcgtgctgagtaccggccagcgatgctgggcattcggtggctgagaagtttttgtgcccgaacacgttcttaccccaggtagggcggccgagcttgtaataccgacagatcgcggccaccaaatgtgcgccgttgtcgaggcaggcgtcagagattttccatgggttagaagaggcgtcggcgtgctcgataccaatgctggtggtattggctgcccagtttccggcgtgccaggcggtgtcgcggtcccacacgagctgcccgatccgcccggaggtttctacctggtagtgggcggaggcgggccgggtctgccacac

SEQ ID NO: 95 - DNA, 6363 bp, Propionibacterium acnes
gtgttgtggactctcggggtcagtctgtccgctcacttgagatggcttaacatttctgaccgacgccgaagtctacgaacgctgcgaaacgccaaccgacgcctttgcaaccaagccttcttcatcaagatctacatcgacgaagacgaccaactccgcgtcgagaacaaccgacctttcgaaatgctcctcgaccctcagatcaacgccaacgccctcacctgggcccagaacggcaacaaggcccgaatcgaaactaaggggttcgagccttgtgcgtggggttacttagacgttcattttgatacaaggatctgggtgggtgcacggaggggctaggtgggtgcattgcatcctgacaggagcgccgggtgagttctggttgactaccagcagcgtgttcggtatgctagaggatagttacgcgacagcgtccgttccaatttctgggagtgtgttaattccgatggtgctgtgatctccgttcggctacgccgagaagcgtccaaatgtttcgacggttttggggatcaatatgtctgctatcgaggtaatcaatctttctttttcattttccgctcagccactcttggataacgtttcattcagcgttggcgatagcgagcgcgcagtacttgtggggcctaatggctctggcaaaaccactctcctgcgcctgatacgaggagagctaaccccggatcgaggacatatcgccatcagtgatgcaggagatgcaggttcttgtcgcttcccttatgttcgtgacgccactggcacagttcaggactatctggacgacgtgttggctggcccatgggagttgctcactcgcttcgaccacgtgacgaagcaactatcggctgcccaaagttcagcgagtctcgctaaagagtacgatcacatactcaccagtcttactctggccgacgtatggtcgctcgaagctcgaatcgatgaagtgttagccggtttaggtctaggccagctgaccggacgcggtcgacagcgcgcactcggctcactctcccctggccaggcagtgcggctcgaactggcaggcatcattatggtcagaccagtaactctggtcttggatgaacccaccaatcatcttgatgacgaagccgtaggctttctgatccagcaaataacagattggccggggccagtgctcatggccagtcataatcgtgcgtttattgaagagacagccacggtcatctatgacctcgatattgccccgtggcaggctttggccacagctgaaggagaggctgtgtctggcgtgtaccggtgcactggcgcctatagtgattatcttggcgccaaacaacacgcccgcatggagcatcaaaagcttcacgccacccagcaatctgaaaaacgcgcgattcgaagtcatcgccgtcgtagcgaagatatcgctcgtggtggagtgaaattagcgaaggcgcagggcatggcacgtaagttcttctctgaccgggcagaaaagaccgcgctgcgacgcacgcgtaacgacgatcaacgcttacacgatcttgctgaacatgaggtgcgaaaaccccgcaactaccaacttaagctcaaccttccaccagtcggctcgcgtggcgggttagccgtcacggcacgaagcgccttcattccaggcaggcttctcccaatcacgttcgaccttgccacgggggaacatttaatactgactggcccgaatggagcggggaaaaccacgctcttgaattggcttgctagtgggaaaacaacaatcgaccctagatccgaagccagcggcactatctctgtcagcgggcggcttgcttacgtcccacagcgcctaccacgcacaggagattcctactttcacccagaacattggaaagacgggatcagagaacttggcacgggaatactccacccatccatgtgggccaccccagtcggccaactttcagatggaaaccagcgtcgagcccagatcgcgttagccgtggcgcagaaacccgagattcttgtcattgacgaaccaaccaactacctcgacctcgccacgcttgaagaactagaggacgcgctacgccaatggaacggcacactcatcatcgccagtcacgaccgctggcttatcaaccactggcagggaacacaaatcgaattatgccccacagatccagcgcccggatcaccgaatcccctcttactcgttaagagccggttcgagccgtggtagtgccgtccttgagtgtgagtttgatagcgccgtcgtggttgacggtggtgtgatcgacgagggtgttccaggcttggtcggagtattcgagtggtggttgggtggcaaggtagtcgcgtacttcgattgcttgtgctcggcggtggcgcagatcgtcgatctggtcgctgatccgttgatgctcggcctcaagttggtggtgccgatcttcaagctcgtggtaacggcggtcgtagtcgtcagggtcgtgggcggtcgtggctgcggggtgatgagttggttcatcagcgtgatggtttcttcgatccgctcccccagcgtggcctgcttggtttcgagctcgcgggtgtcgtagacggtttcgtcgagcaggcgcatggtgtcatcgagcacgtcgttgccggtgacccgcttagccagggctgcgacgaaggcgtctttgatctggtcttcggtgacgtggggtgtcgcgcagtgatgatccttgttgtatttgttgttgcagcgccagatgtagcggcggtatttgctggtggagtgccagactttccgcccaaacctcccgccgcaatcggagcaggtgatcgtgttggcgaaggggtgggtgttggaggtgcctttgcctgcgcggcgggcgagttctgcttggacggtgtcccaggtgacgggatcaatgatgggttcgtggttgctggtgacgtagtactggggtacttcgccttcgttgattttcatggtttggttaggaagtcggtggtgaagctcttttgcagcagcgcgtcgcctttgtatttctcgttggcaaggatcgaccgcacagtggagggcgaccagatttgtttgccacgcggggtggggatgccatcggatgtgaattctttggcgatggtttgtggggttgcgccttcgaggaagcgggcataaatacgacggacggttggtgcttgggtttcgtcgatggcgaggttgccgtcttcgcctttcttgtagccgagcagggacgcgtaggacaccatgattttcccgtcggcgaagcgtttacggtggtcccaggtgacattctcggaaatggagcgggattcttcttgggtgaggctggacatgatggtgatgagtagttcgcctttggaatcgagtgtccagatgttttctttttcgaagtagacctctacgcctttgtctttgagctggcggacgtggatgagggtgtcgacggtgttgcgggcgaaccgggacacgctcttggtgaggatcaaatcgatttttccggcgagggtgtcggcgatcatggttttgaagccttcacggtgtttggtgctggtgccagtgatgccttcgtcggcgtacatgcctgcgaattcccactctgtgcgggattggatgtggctcgtgtagtagtcgatttgtgcctcgtaggaggaggcttgttcttccatctcggtggatacccgcgcgtaggccgctaccctgcgccgacgccgagtaccctgcaccgtggtgtgtccgggtatttttgtggctgggatcgcggtgacacgcttgttccgaatctgcttggtggtcatatcgcactttcctcgtccaggctcaccgccactggcacttcgccgctaatggtgtggatggtgagcgtacgatcgggattgacaacgattttcacgaggcgcgtcagcgcatactcgtcgtcccagtcgtcgaggccaagcacgcgggtgcagatctgggtgagatgggtttctcggatttgtggtgcctggcagggattgcctttacctttggtggcggtttcgcaccaccaaaacttgtaggacgtgtggcggcgtgtcttggtgcggcggtgataaaacctgctacagacagagcattcaatccgagaggtgagcccggtcgttctagctgacggcgtggctccacgtccgagatgtctgcgccgggcgagctcggcctggacggcgccgaacgtggtctggtcgatgatgggcgggtgggattcgtcgacgaggtagcgtggcagctcgccggtgttggtatggcagttcaattctgcaacgtttggccggtaatacttttgcaggattacgcggccggtgtagatttcattttcgagccatttgcggatcgtcttaccgcgaaacttggctccccgcctaggcttgaccccttcagcattcaactgactgatgatcttggcttcagtctcgatgatagccaagtcactacccacgtattggtagccgtagggttggcgcgaatgcatgagcccgtcggcgtatttcttccttatcccccatttaacattcttcgacatggatcgagattcctcctgcgcaaacgatgccagcagggtcagcaggagttcaccgtcagcggtcgcggtatcgatctgttcacgctcgaaacgcactgagacgccgaggattttgagttcgcggacggcatcgagcaggtcgacggtgttgcgagtcagcctggatatcgacttcgtcaaaatcatgtcgatgtcgccggagcgggcggcggccatcatggtctggaacccctctcgacggacggtactggtgccggtgatgccttcgtcgatgaacacgcctgcatagtcccaaccaggggtggattgaatcagatgagagtagtacgacacctgggcggcaatcgaagatagctggcgttcgtgctcggtcgatacccgcgcataccctgctactcgtagccgacgtggcgtggcggggctaggggggataactcgaaaactacgcgaggtcactccctgcttctctttcttctatggcgacaggtgttttggttgtatccatctacgctctaaacctgagtcttatccagtcgaacctgcagcaacaatgcccccactggcgcggttgcttcatgcccgatccgcgtaaggatcacgtggctttcgtttggggtgagtgcgccggtttcggtgagccgatcaataaaggcgacctggcgggcaagatcgacttcggcattgaacatggcacccgtcacggtctgccacctcgggtgctgaagcggtgcctgatatagcaggcatgcgagcaatacttacggtgcttgtttccgtaggcctcgaagctctcaccgcaagcaacgcaggtgaaggtgtatattgcccgccggttgagccgttcggggtgggcgtgctaccacgacaaacgacacacatccgaacagaacctttgccccgccaccgcagcttcaaaatgcccattacagtgttcgcatgccttagcaggctcaacatcaaccgccggatcgatgttgatgtcagctctgcgacagatcgacttcaccgtattgcgcgacatgcccaatctggtggcgatctgcccatacgatgcgcctcggcatcgcagctccacaactcgctcacgggtaatctcacgtgccatgacgcgctcctgctcaatagaaataaggtctctactgacagggcttcgacccaccccgatttataaccaccactgtcctggtgcgatgggaacaaaaatggccccgccaccacctcatgtagtgaggcagcgacggggcgaaacaggacagttttcatgagtcttggtttagtggcggagtttttcgttgacccggcgctggacggcgtcgtagttggatccgagtctgcgtcggcgttcgttgccgttgccgtattcgccgcggatgaccgcgtcagcgagcgcgtcaatgttcggtgccggcttcggtgtgggtgcgggtttcggtgccggcgcgggtgcgggcgtgttgccggtcatgtggtcgtaccagtactgggcgcgagccatataggcggcgtgctgagtaccggccagcgatgctgggcattcggtggctgagaagtttttgtgcccgaacacgttcttaccccaggtagggcggccgagcttgtaataccgacagatcgcggccaccaaatgtgcgccgttgtcgaggcaggcgtcagagattttccatgggttagaagaggcgtcggcgtgctcgataccaatgctggtggtattggctgcccagtttccggcgtgccaggcggtgtcgcggtcccacacgagctgcccgatccgcccggaggtttctacctggtagtgggcggaggcgggccgggtctgccacac

SEQ ID NO: 96 - DNA, 6363 bp, Propionibacterium acnes; identical to SEQ ID NO: 95

SEQ ID NO: 97 - DNA, 6363 bp, Propionibacterium acnes
gtgttgtggactctcggggtcagtctgtccgctcacttgagatggcttaacatttctgaccgacgccgaagtctacgaacgctgcgaaacgccaaccgacgcctttgcaaccaagccttcttcatcaagatctacatcgacgaagacgaccaactccgcgtcgagaacaaccgacctttcgaaatgctcctcgaccctcagatcaacgccaacgccctcacctgtgcccagaacggcaacaaggcccgaatcgaaactaaggggttcgagccttgtgcgtggggttacttagacgttcattttgatacaaggatctgggtgggtgcacggaggggctaggtgggtgcattgcatcctgacaggagcgccgggtgagttctggttgactaccggcagcgtgttcggtatgctagaggatagttacgcgacagcgtccgttccaatttctgggagtgtgttaattccgatggtgctgtgatctccgttcggctacgccgagaagcgtccaaatgtttcgacggttttggggatcaatatgtctgctatcgaggtaatcaatctttctttttcattttccgctcagccactcttggataacgtttcattcagcgttggcgatagcgagcgcgcagtacttgtggggcctaatggctctggcaaaaccactctcctgcgcctgatacgaggagagctaaccccggatcgaggacatatcgccatcagtgatgcaggagatgcaggttcttgtcgcttcccttatgttcgtgacgccactggcacagttcaggactatctggacgacgtgttggctggcccatgggagttgctcactcgcttcgaccacgtgacgaagcaactatcggctgcccaaagttcagcgagtctcgctaaagagtacgatcacatactcaccagtcttactctggccgacgtatggtcgctcgaagctcgaatcgatgaagtgttagccggtttaggtctaggccagctgaccggacgcggtcgacagcgcgcactcggctcactctcccctggccaggcagtgcggctcgaactggcaggcatcattatggtcagaccagtaactctggtcttggatgaacccaccaatcatcttgatgacgaagccgtaggctttctgatccagcaaataacagattggccggggccagtgctcatggccagtcataatcgtgcgtttattgaagagacagccacggtcatctatgacctcgatattgccccgtggcaggctttggccacagctgaaggagaggctgtgtctggcgtgtaccggtgcactggcgcctatagtgattatcttggcgccaaacaacacgcccgcatggagcatcaaaagcttcacgccacccagcaatctgaaaaacgcgcgattcgaagtcatcgccgtcgtagcgaagatatcgctcgtggtggagtgaaattagcgaaggcgcagggcatggcacgtaagttcttctctgaccgggcagaaaagaccgcgctgcgacgcacgcgtaacgacgatcaacgcttacacgatcttgctgaacatgaggtgcgaaaaccccgcaactaccaacttaagctcaaccttccaccagtcggctcgcgtggcgggttagccgtcacggcacgaagcgccttcattccaggcaggcttctcccaatcacgttcgaccttgccacgggggaacatttaatactgactggcccgaatggagcggggaaaaccacgctcttgaattggcttgctagtgggaaaacaacaatcgaccctagatccgaagccagcggcactatctctgtcagcgggcggcttgcttacgtcccacagcgcctaccacgcacaggagattcctactttcacccagaacattggaaagacgggatcagagaacttggcacgggaatactccacccatccatgtgggccaccccagtcggccaactttcagatggaaaccagcgtcgagcccagatcgcgttagccgtggcgcagaaacccgagattcttgtcattgacgaaccaaccaactacctcgacctcgccacgcttgaagaactagaggacgcgctacgccaatggaacggcacactcatcatcgccagtcacgaccgctggcttatcaaccactggcagggaacacaaatcgaattatgccccacagatccagcgcccggatcaccgaatcccctcttactcgttaagagccggttcgagccgtggtagtgccgtccttgagtgtgagtttgatagcgccgtcgtggttgacggtggtgtgatcgacgagggtgttccaggcttggtcggagtattcgagtggtggttgggtggcaaggtagtcgcgtacttcgattgcttgtgctcggcggtggcgcagatcgtcgatctggtcgctgatccgttgatgctcggcctcaagttggtggtgccgatcttcaagctcgtggtaacggcggtcgtagtcgtcagggtcgtgggcggtcgtggctgcggggtgatgagttggttcatcagcgtgatggtttcttcgatccgctcccccagcgtggcctgcttggtttcgagctcgcgggtgtcgtagacggtttcgtcgagcaggcgcatggtgtcatcgagcacgtcgttgccggtgacccgcttagccagggctgcgacgaaggcgtctttgatctggtcttcggtgacgtggggtgtcgcgcagtgatgatccttgttgtatttgttgttgcagcgccagatgtagcggcggtatttgctggtggagtgccagactttccgcccaaacctcccgccgcaatcggagcaggtgatcgtgttggcgaaggggtgggtgttggaggtgcctttgcctgcgcggcgggcgagttctgcttggacggtgtcccaggtgacgggatcaatgatgggttcgtggttgctggtgacgtagtactggggtacttcgccttcgttgattttcatggtttggttaggaagtcggtggtgaagctcttttgcagcagcgcgtcgcctttgtatttctcgttggcaaggatcgaccgcacagtggagggcgaccagatttgtttgccacgcggggtggggatgccatcggatgtgaattctttggcgatggtttgtggggttgcgccttcgaggaagcgggcataaatacgacggacggttggtgcttgggtttcgtcgatggcgaggttgccgtcttcgcctttcttgtagccgagcagggacgcgtaggacaccatgattttcccgtcggcgaagcgtttacggtggtcccaggtgacattctcggaaatggagcgggattcttcttgggtgaggctggacatgatggtgatgagtagttcgcctttggaatcgagtgtccagatgttttctttttcgaagtagacctctacgcctttgtctttgagctggcggacgtggatgagggtgtcgacggtgttgcgggcgaaccgggacacgctcttggtgaggatcaaatcgatttttccggcgagggtgtcggcgatcatggttttgaagccttcacggtgtttggtgctggtgccagtgatgccttcgtcggcgtacatgcctgcgaattcccactctgtgcgggattggatgtggctcgtgtagtagtcgatttgtgcctcgtaggaggaggcttgttcttccatctcggtggatacccgcgcgtaggccgctaccctgcgccgacgccgagtaccctgcaccgtggtgtgtccgggtatttttgtggctgggatcgcggtgacacgcttgttccgaatctgcttggtggtcatatcgcactttcctcgtccaggctcaccgccactggcacttcgccgctaatggtgtggatggtgagcgtacgatcgggattgacaacgattttcacgaggcgcgtcagcgcatactcgtcgtcccagtcgtcgaggccaagcacgcgggtgcagatctgggtgagatgggtttctcggatttgtggtgcctggcagggattgcctttacctttggtggcggtttcgcaccaccaaaacttgtaggacgtgtggcggcgtgtcttggtgcggcggtgataaaacctgctacagacagagcattcaatccgagaggtgagcccggtcgttctagctgacggcgtggctccacgtccgagatgtctgcgccgggcgagctcggcctggacggcgccgaacgtggtctggtcgatgatgggcgggtgggattcgtcgacgaggtagcgtggcagctcgccggtgttggtatggcagttcaattctgcaacgtttggccggtaatacttttgcaggattacgcggccggtgtagatttcattttcgagccatttgcggatcgtcttaccgcgaaacttggctccccgcctaggcttgaccccttcagcattcaactgactgatgatcttggcttcagtctcgatgatagccaagtcactacccacgtattggtagccgtagggttggcgcgaatgcatgagcccgtcggcgtatttcttccttatcccccatttaacattcttcgacatggatcgagattcctcctgcgcaaacgatgccagcagggtcagcaggagttcaccgtcagcggtcgcggtatcgatctgttcacgctcgaaacgcactgagacgccgaggattttgagttcgcggacggcatcgagcaggtcgacggtgttgcgagtcagcctggatatcgacatcgtcaaaatcatgtcgatgtcgccggagcgggcggcggccatcatggtctggaacccctctcgacggacggtactggtgccggtgatgccttcgtcgatgaacacgcctgcatagtcccaaccaggggtggattgaatcagatgagagtagtacgacacctgggcggcaatcgaagatagctggcgttcgtgctcggtcgatacccgcgcataccctgctactcgtagccgacgtggcgtggcgggtctaggtgggataactcgaaaactacgcgaggtcactccctgcttctctttcttctatggcgacaggtgttttggttgtatccatctacgctctaaacctgagtcttatccagtcgaacctgcagcaacaatgcccccactggcgcggttgcttcatgcccgatccgcgtaaggatcacgtggctttcgtttggggtgagtgcgccggtttcggtgagccgatcaataaaggcgacctggcgggcaagatcgacttcggcattgaacatggcacccgtcacggtctgccacctcgggtgctgaagcggtgcctgatatagcaggcatgcgagcaatacttacggtgcttgtttccgtaggcctcgaagctctcaccgcaagcaacgcaggtgaaggtgtatattgcccgccggttgagccgttcggggtgggcgtgctaccacgacaaacgacacacatccgaacagaacctttgccccgccaccgcagcttcaaaatgcccattacagtgttcgcatgccttagcaggctcaacatcaaccgccggatcgatgttgatgtcagctctgcgacagatcgacttcaccgtattgcgcgacatgcccaatctggtggcgatctgcccatacgatgcgcctcggcatcgcagctccacaactcgctcacgggtaatctcacgtgccatgacgcgctcctgctcaatagaaataaggtctctactgacagggcttcgacccaccccgatttataaccaccactgtcctggtgcgatgggaacaaaaatggccccgccaccacctcatgtagtgaggcagcgacggggcgaaacaggacagttttcatgagtcttggtttagtggcggagtttttcgttgacccggcgctggacggcgtcgtagttggatccgagtctgcgtcggcgttcgttgccgttgccgtattcgccgcggatgaccgcgtcagcgagcgcgtcaatgttcggtgccggcttcggtgtgggtgcgggtttcggtgccggcgcgggtgcgggcgtgttgccggtcatgtggtcgtaccagtactgggcgcgagccatataggcggcgtgctgagtaccggccagcgatgctgggcattcggtggctgagaagtttttgtgcccgaacacgttcttaccccaggtagggcggccgagcttgtaataccgacagatcgcggccaccaaatgtgcgccgttgtcgaggcaggcgtcagagattttccatgggttagaagaggcgtcggcgtgctcgataccaatgctggtggtattggctgcccagtttccggcgtgccaggcggtgtcgcggtcccacacgagctgcccgatccgcccggaggtttctacctggtagtgggcggaggcgggccgggtctgccacac

SEQ ID NO: 98 - DNA, 20723 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacttttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaggtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacggggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgactacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggtcgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaagtgccaacactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcagtttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacgaccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccgtcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccccctctcggccccaccacaacatcaattgctgactcgaacacctttgaggcagcgctttcggcttgcgcaaccccatccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtataaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtggaatgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 99 - DNA, 17173 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtcct

SEQ ID NO: 100 - DNA, 599 bp, Propionibacterium acnes
accagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacg

SEQ ID NO: 101 - DNA, 17175 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcaggctgctgccataaccgctatcacctctgatagtacttttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgcaactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttttcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgttcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgagggtggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtgggcatgtgatggtggcccagccttctggttgccaggagatgtaggggtcgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaagtgccaacactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgcgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacgaccggccacgagcacatctggtccgacccggagacctggaatcgggagttctggatcgcaggtgacaagacgatggccgtgtatcccagccttgacaaactccgcgaagctgaccccaatgtggccgaacgcgccgaggccacggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtccttg

SEQ ID NO: 102 - DNA, 599 bp, Propionibacterium acnes; identical to SEQ ID NO: 100

SEQ ID NO: 103 - DNA, 17061 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacg

SEQ ID NO: 104 - DNA, 1527 bp, Propionibacterium acnes
accagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacaggg

SEQ ID NO: 105 - DNA, 17061 bp, Propionibacterium acnes; identical to SEQ ID NO: 103

SEQ ID NO: 106 - DNA, 2003 bp, Propionibacterium acnes
accagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 107 - DNA, 17045 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacttttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtacttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgggggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgagggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgactacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggtcgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaagtgccaacactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacgaccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatc

SEQ ID NO: 108 - DNA, 582 bp, Propionibacterium acnes
accagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatc

SEQ ID NO: 109 - DNA, 16496 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgccccgctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatctcc

SEQ ID NO: 110 - DNA, 16494 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgcccgcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatct

SEQ ID NO: 111 - DNA, 16494 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggggcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatct

SEQ ID NO: 112 - DNA, 16494 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggtcgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacgaccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatct

SEQ ID NO: 113 - DNA, 16493 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcagtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcgggggagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatct

SEQ ID NO: 114 - DNA, 16491 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacttttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttaccccgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggtcgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcagggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaagtgccaacactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacgaccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccat

SEQ ID NO: 115 - DNA, 13424 bp, Propionibacterium acnes
ccgcgcggggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccat

SEQ ID NO: 116 - DNA, 12654 bp, Propionibacterium acnes
gtgagtttcttccattgatgacaacagcacggtgctgccgtctgtgtgcggccccccaccccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggtcgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaagtgccaacactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtcccgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacgaccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccat

SEQ ID NO: 117 - DNA, 12567 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggc

SEQ ID NO: 118 - DNA, 9859 bp, Propionibacterium acnes
ggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatct

SEQ ID NO: 119 - DNA, 9540 bp, Propionibacterium acnes
cggtgtggcggggtgcgcgggtggagagggtgccgcgtgggttgatttccacgacgacgatgtcgtcgtgtcctgctgtggtggcgagggcttgggcaaggatgacggccagcggggttttgccggtgccgcctttgaggttggcgagggtgatgatgtggtcggtgagttgggcgggtgcggcggtgtggtgagggttggcggtgaggttggcgatggtgaacagggcatcgagatcgtcggtggtgttctgctcggtgggttgggggtcgccggagatgatcgggtcggcgcggcgcggctgccatgccggcctcaccactgtcacgaccaccacgggtctgctggcgctgtgtgggtgtcgtcggcgatgactcacgatcggcagtctcaccatcgtctcggtgatgctcggctagcgctggacccggtcaagttcgggccggctcacccagtggtgatgactcggtcacagaaccgctgccggtcgttatctcggacgtctcgactcctccagtcctgatgggcgttggagccacctacacctactctcagaacgaccccgacctcgtgtggggcgggggcagatgtcacttgggccaatcgagagcccaggtgatggggaaagcaggggtgtgatatctgtcctggaaaactgggcagctgctaccgtggattgacggatctccacgaaagaagggaatgcgaccatgcagatcaccgtcaagaccatcaaagatcatcgggttcgcactgtccagaccgccatgagcagcgccttggggattggttcccaggtagacatgctcgcccccggcggttccaccagctcgagttccggttcatgctgctcgtgctcgacctgcgcggtagtggcgcagcctcaagactgaacggctggtcagccccaggggcgtggcgctcatcgcgtcacgccccttctattcgctggacagggtgcgcgagctgaggaacatcgcggtgtgtgcgatgacgaggggcaggagcaagtctgtgcgggttgccaagtagccctgcgcgatggccatcacgctggccccgacggcggcgaagacacctccgatacgtcgcttcatgccgccgaattgcatcaggacgaataggactcccgcggtccacatccctccgggcatgcatctgggaaagatgaaccggaagatgatctcttcacaggagagctggagtactagcagcgtagcccccacggggagactcacctctactgacagacggatcgtcttcatccacccacccgagctggcatcgaccatttcggtggccatgcgcgaccggtggcctcgtgcctctcgctgcgtgtcgatccagccgagcagtccgtggacgctctccgctaggactcctgacgcgacagtctcaccaattcctaagcccacggcgaggaccgcgacgcccccctgcacggcaggctgtgtgacttggtggtcccaccaacccgccggcaggaccatgcgtgcgaggctgcacacgagcaggaggtggagggtcacgacgagcgacatctggaataccgcttgccgttcggcgatggtggcgttgggaaagagcggtaggccggcacgggcagcggcgctcgacagcttccgcaagagcggtttggagacgaagtagtaggcgacgtacagcgccagcgctgtcgcgatgatgatcatcggtctgccaccgagctgacccgccgatagccgtttctgttccaccaatactggctgttgtagatcaggtggcccagaacacaggcccagatcccccagaagatgaacaggatagtccccaaggcggcgagcgggatcttggagaggacctgtccccgtccgaacaccgagtggccgcaagcaaacaagagtgctcccacagcggtgagcgcgagccaggccggggttgctcgcagactgatcaccgggaccccgacccggaagccgacctcttctcctacagcgatgactagcaactgccacagcggcatgttctgaacggagcgcgcgactcgggctcgagtcacccacacgggctgttgagcgctcacatcaccactcaggtaccccggtgaggcacttcgcttagtactggggcccgatgtgcgagcattcgtgatgtgtcgcaggatccggttgtcaagccaagaggccagcagggctccggcgacagtgacgggtagcccgatcagcacgaggccccagccatgcggtgccgagaggtttctggccggcgtgcacgcgaggcaggcaaatgccatcactgccagcactacgacgtagatggtcgcataattcgacttgcgggtgacgttgccgaccatcttggccaaagtcgctggggaccagctgatgagtgcgatggtggtcagcaggaagcaggaccagacagacatccggcgcactcaggggtatgggtgcggctgtgggttttggaaaccgccatatgcggcgtagcgggggtgtgcccgcatgggtgcgctgggcagtgacagggcgagcagcccaggcgcccagagcctgacacagtgcagtcccagcccctggatctctatggtggtgaaatcttcgatgtacaggggtgacacacaggtgatgctgttgaccacgctctttaccagttccgcccccgtgtgggtgtcgtcaggtggcaggtcttcggcttgggcaatggtgcccgcgtcgaatttcgccacaactgattgcgcggcctgatagttcctcgcgtagtaggagacgttcgagtcgaggtcaagcatgtcctccgtggacatactggacgcgtcggcctcggcgtcgaaagacgtccataccgcgagcatccgaaccccgctgcactcgagaaacgccttgtacatggctgcttccagacccgcgtctgcacctaggccgacggcgacgaggggaagttggttgccactaccgaccatcatgcatgccacggtgaaatgcttgagcccgggagtcggaagccagtagaaacgcagttcgtggcttcggcccgctgcacgttccacgagccgctggatgcgctggaggcggggtccttcgacgcggatgcgcacaggtgacgaggctccataccacaggcccatcgcggcatctacctggatcaattcataagccgcggacagcgttgcggcgacgcgtgaagtgtggacggcggtgccggtcgtcacggccgttcccagccacggctcaccgtcgtgccgacgggggttgtaacccaggtaaaagaactgcgccgggatccactcctgccgggaggtcccgacacggggagtcttgacccatgtcatgggcaagtcgtcgcgataggtgtcgaacgcacctccagccactcgttgcgcgaagccgaatgcgcccagatcgagaacttcgtcctcggtccgggcgaggagttcctgacgagtcgcccagcgccgttcgaagggactatggagaatcccggtacccgcgcagtagcgctcgacggcctccgcgtagaccttgatctctgcctcaaactcgttcagccccaccccaccgatgtggtagctacccggcttggggtcgggccggtcaagcagtgcgtgcatccccgtgagttccccaccgttcacccgcacgcgggggccgagcgcggggtgcagcgagtagccgacggaagtcaccagcccgcatagcgggctgtaggtgcgccgcctgagccgggctgcggtctcgacggggtcgctatcctggcgaagcttcatcgctcgccccctgccgccagccactcacggatgtcgtagtacaggtccggagcggtttcaacctgcgctggtgcatcaaaacgggacataggtaggacgtcgttgtaggcgatctccatcgtcggtatgtagaccgacaacactttgttgcgcgtcgtgttgaggccgttgcgggcgatgctgacagcctcatgcgcgacgtgcgcggccaagatcgcgcgcaccgacgctgccacggccggcgctccggcccttacgcggtcggcagcggccacccgcatccaggacaggtagctctgccgttcgcgcaggttcatcgcgacccgctgctcgaaggtccggtaggacgaggtcgcaccagggacgacgtagggacccacgtacaaggccggcccgtctacagctgcgtggagccacgacaggtgggcgcgtcgggcgaacaggtcaagggcgcgcagcatagccgggttgttctgcgccagcgctaccacaaggagtggctgcaggtccggcgccgaacccagcaacgccaacatctgggaggcctcctgctccatgtgcaactcgtcggccgactgctcaagccgcaggcctgcgaagagggtggctgatggctgcgtgtcgtcagcgaggacggtagcctgcagcccctctccctcgagaatctgctggatatcgccggcgaggagcgcgtcgtcgctgaatacccacaccgggcgcgtctctctacctccatccatcttgtcctcaacgttttcgaccagcgcaccgatcgatgctaggtgggccatcacgtcgtcaagggccgcgcgggtcaatccgggcacccgggacacgatctcgggcggctgcagtccttggctcaacaagtccaaggccggccacagggtcccggtggcgtcgtcgtcctccagcgttgtgctctcggcgttccagacgcctcgacggaactccaccctgtccatcgagtaaggcaccatcatgaggcccggtgaaatgtggttggtcactttggctcctgtacagcctaggcttggacgcccacggtcatggtgtgggtcgcggtttggaaaatcccgtcgaggttgagtgcctgattgagttcgtcctcgtagaagcttgaggactcgactgaggcaagaccgagccccgtgcagaccaagttgatctgttgtgcgatcgccccgacttcttgaagggcgaacctcaaacccctggctccgtacttccgcatcgccctccacggcgagatgacgaacaccaagtgcactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaatcctcgacacatgatcccaactcccccggaggggcttccggggctgttcagccaccagatcagccaggcggcgagcccgactctgccacccggaccctgcagagcgtgcctgctgccgtcgtgtcgtgtcgggccagtgggccaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacg

SEQ ID NO: 120 - DNA, 1583 bp, Propionibacterium acnes
accagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcggg

SEQ ID NO: 121 - DNA, 6610 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttcccc

SEQ ID NO: 122 - DNA, 4467 bp, Propionibacterium acnes
cgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgttcatgctctgtggtggccggtcctgagggcggctcgcaggatctcccggcgctcacggcgacgagcctggtagccaaggtctgcatgttcggcggcgagacgggctttgagggttgcggcttctgcacggcggtggagttggtcgtcgatgagttgggcgcgggccagacgccgcttatgggggttgtcgtgggtgaggggggcgtcgaggctgccgtcgtgggttagggccagggctgctcgttcggcgtcgtcgaggccgatgtggtggacggtcacgggtgcggtggtgacgtcgaggatgtccaggtggatgttgtggccgccgccgggggcttcggggaagtctggtgggctggcctggccggtgtcggggtcataccaggacaggccgatgatctcggcccagggtgggggcgggcagacggctcgcagaagggtgtgggccaggaacgtgttgcgggccatgatgcctccaagggtgaaaagcagtcgagtagcgatgacggcggggtagccgtctgctgggctgaggccgaccgggcccatgtcctcgatgctcttgtgctgcggccataccccaaagctaccaaacagtctttttaatctcaaagatacaaacagtgcttgacatattatctgcagcgaaagatactttcatcatggtggctgatcatgattacgcgactcctgacgatgagtggatgacacctcctcaggtggcccgtgtgattccgaacaccactgctcaggctgtccggcgctgggctgaggagggtcagcttcctggggcgtttcgtactccttctgggcgttggcatattccgtggtcggctgtggtgggcatcatggggtttgatccgcgtgagtccgcatcaccgagtgatcgtcaccagagctgacagagtcgtcgatgagctttcgagtgcagagctgatggcacgacggtctggatacttgtggagatgagagacgaccacatccagtcatggtcggggtacaccgaggggcagattcagcagtgctggcacgatgaggttgcccctgccattgactcgctcatggagcaggtaaggtctgttgccgagactcctgtgccgccgggttcgagattttacggcgatgagcagtgggccaagccttttcatccgtctactgcgatctgcggttcaatgggtccgccagcgatcacttgcacgcgctgaagctcctcgtctgggaagcgaacgtccaccatgtctatgcgccgtacacccttgctcgtgcatctattgaggcatcgtctactgctgtgtggctgttgagcacgaagacgcgcggagaacgtgtgctgcgagccttgcgatggtacgcgcaggattgtcacgactcgtgcaggttcatggatgatgagcagtatcgtgaccacctattgcggcgcattgaggggactgtcgctgcgggaaatctcgactcgcgcgctgctaggaaacggtaccgtgcaaccgatgttgtcgatgaggctgatcagctggttcccggaactctgagggcgtggcgagctttttctggtatggcccattcccgtatgtgggcatccagggggctgctcgacatggaagtgctgtccagtggccaaggaatggttacggcgaaggtgacgagcggatcggcccaaatcctttgggccgtcgtggcagctctgaatgttgctctcagtgccgctcgcttgtggcgtgattcgatgtgctcaccgtttgctgttgcccagtcggtagacgcgatgccagaggcgtttcgccgccctgtttagggtctgatcggggtagtgggtgttcacggggtcccaggttggccatggggcggcttggtgatgtgagttgggttgtgtggcagcctgggtgttgggtgtggcttcgttggccacgaaggcatgctcttccttgtgctgggacttgagtccccagtgctctcccctttgctagtggggggtggggtccccggaggtaggtcctccggggactttttctatgtctgtccgtgccccaggatttcgtatctaggcagtaccaattttgggttagttggaggtttctttggtaatggacagggtgagggtgatgaagaggtggccgtccttggtggcagaaattttctcgaacttcagctgaatgttgttatcagccactatctgttgggcggtgaggtgctcggagagcttctggaatccttcgcggatccacaggttgtaggggttggtgaccgagaccgaagggtatgggtcgaccttcagcgtcaggactggctggtctgggttgagggagttgatcttcaccagtttggggtaccggtcgcactcatgtgtctcttgtgttgggggccagcagtcgggggcccattcctcccagtggtcacgcatctcacgaagtactttcctgcatctcagcctctgcaggagctcgcgcgccaccgatgggagggctgccatgatgagggcaaggactgcgaacccgatgatgtaattgaccgtgtccctcgtcacgccgttcttgccgaggattccgatggcgaacgcgatgacgacaccgcccaggcacaggtgcatggggtcatgctgtgatggtttttcttcttcagcgactggtggggctatagtcatgtgtgccccttagtactaagtgatactggtgggttgcttttccccggtggccgtgtgcaagacggccaccggggttttccttcatgttcctgattttatctgcccggtgtggcgttttcatctttgtgtgggtggttcgcctggggtcttggagtgtggtgacgcggtgatggtcacggtgacggtgactgtggcgcgtggcgggtgaggtggttctttcctggtctggtgtgtggcccaggtgagtgtggtgatgagggccagggtgaggatgatgaccagggtggggagtagtttgtctggccggtgtcgccgggcttggtggcgcggcatgtttttccagggtgtgtctccgaacaggtcgtcgtcggaggggtcgtcgtggttcatagggtggccttggcgatggtggtgggcgagtttggtccaggtgatggtgccgtcggaggcgatgtggcggtcggcgggcagggtgtggacggtccatccggcgtcggtgagggcggtggtgaaggatttcttgatggatcgtttgggtaggtcgatgggggcgtgggtgccgacccagatgcaccggtttttgaggtgggtggcgccgaggtggttcatgtcgcggaccatgttttgggtgagtgtgagggtgtcggggtcccattggacggggatgatgatgtggtctgcgatggtgatggcgtgttgccaggcggcgtcgaggtcgttgtttccggtgtcgaggatgatgacgtggaagcggcttcttagggcggtgatgatgcggtcgaggtcgtcggcggtggggggtgtgatgaggctgttgtggttgtcggtgatggtgggtaggcatgtgatggtggcccagccttctggttgccaggagatgtaggggccgaggtcgcggggttgggaggcgaatcctgggtgacgggctgcgcgggcgaggtcgatgacggtgttgtcggtgtggcggggtg

SEQ ID NO: 123 - DNA, 3927 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacttttagtactatcagaggtgattcaagattctcctgtcgagcagccctacagtcacgaagtcctgcgatcgtcatcgcttaaggtagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtttggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacgagtggggaagtgccgaggcggccgcgctcggccagttgtacgcccaccacctgacctgcatcgaaggagccctgtgatgacccgtccagccccccgaaagtcctcattgagcggatcaactccggtcgccccgccggctcagacggcgccggcaccgtctgccgcacctaccccccacaaggccgatgagtcacagacgagcagcaccacgaggaagtggcggcacaaggtgtcgttctaccaggacccggccgacaccgaccgggtgcgcggggcgatcctttacacgatgacgaccgagggcaaccggaacctgagccagttcgtcaacgatgccgtcatggccaaggtggtcgagctggaagtcaagtacaacgatggccagccattccccgctgtgggagcccgaggactaccccagggcggtgcagccgccgccggtgagtagaggaccatcgaccgtcgggggcttcaccatgcccccgaccctcggtcatcctgatcctcttgtcgatggtggtgacagtgggggattcacgcctcgttcagatcagaggaagtctcaccgcgtgattagtactatcaaatctgacagtactaacagagcagatagggttccctaggtcgagctgtatcacgccgacaaccagtgagccagtgatctacgaggggcgcaatatgcacccgatcggtagccgcgaaggcctcgccctgccccgatagtactatcaccactatcaatggtgctagtggtgagtttcttccattgatgacaacagcacagtgctgccgtctgtgtgcgggccaccagcccgcacacagttgccgtcgaggacgttgt

SEQ ID NO: 124 - DNA, 3842 bp, Propionibacterium acnes
cactccggccgcatccgattgctccacggccggctcgccggccatcgaattcctcacgccgcgacagccctcttcaccggtcacgggcaccagtcgatcgatgaccggcgagtagcggtagacgccgcgactcaagccggacacccgttgtgcggacatgaagatagacacgggatacagccctccaccagacgggacagcgcgtacattataccgcacgatatcaccgctcgaacgtgggacatccacgtgccccgtcacaccggcagcacctctcagaaacgcagctacgtcacgcaggtctagggattcgccggtgtagttccgtccgctgcgccggcgggcgatcacttgctcgaggggtgcgcgcaccctgctggacctgggaagttcgatcacatcggcagcgaacgtgtcgcgatccatctgtccgtacgtaacgatcatggggtcaacgaaatagtcgccgaccgagacgttgaactccatatccccccgggcgatgcgcgaggcgagcaagaagtctgcagctgcgttagacagccccggcccatcagtgttgtcgcagcggaactcgtgggtccgaaaccccacaccttccgtgcccgggctctgcgctcgatacgacgtgatcgcagaactagccttccttaaaccgcccggagtagctaccatgaccgtcccctctgaggtctcccgaacacttgcgacaatagcagcatgtgggggcagccgccagaggcgggcatccttgtctcgacaaccattgacctccggattcgatatgtgcataatcatagtcgtgccaacacgaaacgtgtacgtctcggaagacgacctagacctgttcgccgaagccaccgagatcgctggaggcctgtccgcagcggtgttggaggccttgcgcagctacgtagacaggcaccatcgcgcggccggcggattcgacgagatcgagctggagctgcagaacgacggtatcgaccaccgtgtcaccttcatgggtcgccgcctgatacacatccgccgtccagatcccgagggaacccgcatagacactgtctacttgaccgccaaacaccaattcgccgttgccaccaaaatccaacgacggctgccagactggacggccggccacgagcacatctggtccgacccggagacctggaatcgggagttctggatcgcaggtgacaagacgatggccgtgtatcccagccttgacaaactccgcgaagctgaccccaatgtggccgaacgcgccgaggccgcggtcaaaatcccgccgttcgaggtcctggacatctgatgacagaatcatcatcttcccggcggcaattggcaatgccggtgctgtcagtcacggatctagccaagaaatacgtggttcatggcggctacgaggtcccggcactcaacggtgtctcgtttgacctgcacccgggagagatgctgggtttgttcgggccaaacggtgctggaaagacgacgctggtcaggatcatcgcgggcctcttatcggcagattctggagacgtccactggggatcggatcaaggtcgggccaggttaggctacgtgtcccaaaagggtggactgcagtacgggctcacgtgccgggaagagatggtcttccacgcacaatgcttcggccagtccgccaagcaggcccggactagcgtcgacgaggtcgccgcgatgctgcactgcgattacctgatggagtgggacgtcggaaggctctccggtgggcaacgccgaatcatcgaggtagggctagcactcgtcaatcaaccatcggtcgtcctgctcgacgagcccaccctgggcctggaccccgcaacacgcctgtcgttgtggcaaacggtaaagtcggcacgccgtgagaccggtgctgccttcctcgtcaccacccactacattgacgaggtggccgagcacctgtccaacgtcagcgtgatcaaccacggaaccgtcgtcgccaacggctcgccagcgcacatccgagaaatgttcgcgaccggggaagtaacgctcggcgtggccgaggatacggtggacagtgcggtggacgtgttggctgggaccgcgttcgaggcgcaccccaccgaaaccgtcccggggatcgtggtcaggtccaggcatcccgacgtggacgcggccaagatcatcaccatcctggctggtcatggcatctcggtggactccatatccgtacgcgaggcgaccttggaagaggcgtttctcacgatcacaggcagtcgagacccggagaggcaaatcccatgaacacttgcttcaggcgatatgcggcgatgtcgctgagagcgcggcgtgatttggccctgacattcatccagcccctcgtctacctagccctcttcggaccgctcttcgtcacgacgatgaagatgtcgcagagagctaccgccgctacgggttactccctatacatcacgggcctgtccatccaaatggccatgacgatcggtgccttcgcggggctaaccatcatcctcgaataccgactcggcatcctcgaacggatctggagcacccccctcacggggagcaagatgatggcggggcgaatcgcgcgcgacgtcgttatgatgatgatgccgatactggtcgtcttcatcatcggcctggtgctgggaacacgccccagcccactgggcctggcgacctacttcgtgacagtgctcggcacaggagccacgttcgccggggtctcctacgcggtggcactcagaacgaagagcgaggcagcgctatccgcgatcttcaacctcatcctgctacccatcctcctgctgtcggggatcatgctgcccatgtcgttcgcaccacactggatcgccaccgctgcccacgtgaacccgttgtggtacctggtgcaaggcgcgcggaaccagttcagcgttctagggctcgtggcggcggccccatggagttgggctgtggccatcgtcatgtcagccgctgccttcggctgggcaagccacgaattcaacaagaggcgctgacacaaagaatggtgccgggaacccaggtccccggcaccaccgagtgcactcgcgacgtcaacgcaccgttgcggtcactgcgcaggtcgagcacgaggacgacgagcccgcgctgctgcaggtcgagccgccaggcgcgagcaggtcgacgttagcgtcggcgccgccgaagacggacgtgacggccggctgagaggtgcggatgcggtgctccagcgaggaggtggtggtgagtttcatgggaggtgctcctaggagtgagacgagaacaaaccctagcgataggttagcagtccgcaaccgactccgggaatagtagaagcgcgcatccgtagcggaagaccttagcctgattacagtgaccctgttcgcgtctcaacattattccacacccccgagcagcgaacgacaccgcgatgatgatccgtcgcctctccaccgaagaactccgcgcccacatcgcaccgggccgccgtcccgtgcatcagacctgccgtcaacgtcggccatgaagctgggaaggtggctctcgtctaggagcagacgcgggacgcctcctccaggttgggccggggaagtgtccggttcttgatgtaggtggcggtccctattgatgggcgttgaccgtgggaatgcggtcggcgaagggggtggcgaacccgttgagcgcaggcttccagcgcatgcatcaacgctgtctgccggccaccggcaagcctcacccgcccgtcatggccatcatcgaggtgccggtgaaccctcgacacatgaccccaccccccccggaggggcttccggggctgttcagccacc

SEQ ID NO: 125 - DNA, 3694 bp, Propionibacterium acnes
cacccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcgtctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccccctctcggccccaccacaacatcaattgctgactcgaacacctttgaggcagcgctttcggcttgcgcaaccccacccacgacaccgtccgcttactactcgaagttgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgcagaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 126 - DNA, 599 bp, Propionibacterium acnes; identical to SEQ ID NO: 100

SEQ ID NO: 127 - DNA, 3076 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggtgccaagctccccacggaatctcaggcatcggaaaccagcagccgaacttccacagcatgagcgccctacgaaaaagcaggccgccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggtgagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgc

SEQ ID NO: 128 - DNA, 2557 bp, Propionibacterium acnes
aaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 129 - DNA, 599 bp, Propionibacterium acnes; identical to SEQ ID NO: 100

SEQ ID NO: 130 - DNA, 1871 bp, Propionibacterium acnes
gccgacggttctcaagaactcgccggcggcctgcatcgccactcgaactgtaaccgtggtccgaccccgtgcacaggtaagctccacactcccaccaggcatggccgaggcagtaccaagttgccgtggcccatcggcagatttggttaaattttgaaaagtcatatagactccttctgtaaatttttaaatctcataggactctcgccatcgccagccagcttcgacaggagtcccgatgtttcaccgagtgaaatatcggcaccgtttgagttgacctaaagctcaaaagatgctagaatccatcttacctcgttaggggcgttttgtcaaacgcccctatattgcgtgtcttcgcgcgtcgtagcgctgatgctgcgcctgtgtcgactatccgtttgtaagtactttcgatgacaccagcagtggctactcatgactggtgcgtgcgggtctaaagcagcagggaaaggaatcgcagtagaagccgcttgattcctatcacccctgatggtactatcagtactaacagagcagggcttactcgatgcgtgagaatcggggacatgctgagcctctcgtaggtcattggcctgctgggcgtcagtgtggcgcggttcgatccagtgaactctatcagctctgttagtactgtcagagttgatatattcgaccccaggaggagcccatgagttacatcgttcgcaccggaaatttggtcgacacccccgagctgcgtgagggagagcatggcccgtacacctacgctcgcgtcatcgtgtccgatcgcattcgccaggaggacggcagctacgtcaacgggccagcgatcgcctacgacgtcttggcgggtggcagccaagccgtgaatctggttgaagccgccaaggcgagcggcaacatccgcatcatgttcgcgggccgttaccgcgtcaccgagtggcggggggagcagggcactcgtatccagcatgaggtccgagccgacgaagtgagcgtgagcctgctcggtcagagggtgaccgtggagcggcctcgaggtgacgtggcatccaaggagagcacgtcgttctgattgagtccgggggcacggtggtcgccgtggtaaaccgtgcccctgacagtactattgacactattggaggtatcagtgtgactgctcaaattttcgccttgtgcaaccagaagggtggcgtcggaaagtcgacatcgacgtttcatctggcccgtgccgcggtgttgcgtggccagcgtgtgcttgtcgtcgacaacgacccccagggcaacctgacgtctgtcgcggccgccgagcccgtgggggaggatcaggcggggctggccgatgtgctcagcgcgcgtgctccagagaccctccgcgatgtgatcgtgccgggaatctggtctggcctcgatgtcgtgccgacgtctggcatcacgctcggctgggtgcgtgacgaactcgtgatcgccggtgccggccgagaaggccggctgcgggaggccctggccggcgtcgaggacgactacgacgtgatcctgatcgactgtgctccatcgctcgatcagctcacgatcaacggcctggtggccgcccagggtgtcatcgtcgtgacgcactcgaagttgtggagcgccaacggcctcgcccagctgctcgacaccatcgacagcgtgcgcagctactacaacggcgcgctgcgcgtggcgggcatcatcgtcaaccagcacgaggagaacaccatcagcgggaaaacctggctcgacgagctgcatcaggctgccgagtcccggaagctgaccgtgcttgacccgccgatccccaagcgtgtcgtcatcgccgataccgtcgaggccgcgcgcggtctcgacga

SEQ ID NO: 131 - DNA, 1729 bp, Propionibacterium acnes
cacgcacccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatctcc

SEQ ID NO: 132 - DNA, 1729 bp, Propionibacterium acnes; identical to SEQ ID NO: 131

SEQ ID NO: 133 - DNA, 1725 bp, Propionibacterium acnes
cgcacccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatct

SEQ ID NO: 134 - DNA, 1719 bp, Propionibacterium acnes
cccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccat

SEQ ID NO: 135 - DNA, 1656 bp, Propionibacterium acnes
accagcgggggagagcgactaccgctgcagccggtccaaagcgactcttcacagatgagggggtggatcggtagctgacccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccccctctcggccccaccacaacatcaattgctgactcgaacacctttgaggcagcgctttcggcttgcgcaaccccatccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtataaggaaccggccccgctccaggcgtgtgcccaggatcgccacaacacgtcgagctcgaccaccacgcccggaatagattcccactccaaatccggatcagcggccgccacgt

SEQ ID NO: 136 - DNA, 1438 bp, Propionibacterium acnes
cacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 137 - DNA, 1436 bp, Propionibacterium acnes
cgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 138 - DNA, 1436 bp, Propionibacterium acnes; identical to SEQ ID NO: 137

SEQ ID NO: 139 - DNA, 1432 bp, Propionibacterium acnes
cccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 140 - DNA, 1432 bp, Propionibacterium acnes
cccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatatccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcgggtgggcctcgaccaggtcgcgggcaagggcatcgttgcgggtgtcgcatccgttgtggccccaggggcgggtcaa

SEQ ID NO: 141 - DNA, 1438 bp, Propionibacterium acnes
cacgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgcttcattttttcttgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 142 - DNA, 1399 bp, Propionibacterium acnes
gatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtggaatgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcccggtggctgcgtcaatgatcgatatttcgatgatgcgcccgtccaggtcggtggtttcggtgtcgaggatgactccgactccgggttctaggagttggggatccaatgggtggtcatcgtgtggctcctacagggagtgtctgggctggacagcggtgcaatacccgcgccatagcggttttttctgcgggggtgacccacagctggtatttcgttttgacggcgatttggcgggccacgtagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 143 - DNA, 1155 bp, Propionibacterium acnes
acaaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacg

SEQ ID NO: 144 - DNA, 715 bp, Propionibacterium acnes
accagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgtgccaccagcgggggagagcgactaccgctgcagccggtccaaagcgactcttcacagatgagggggtggatcggtagctgacccctaggtcctgatgtgggtcgaggtccttgga

SEQ ID NO: 145 - DNA, 1134 bp, Propionibacterium acnes
gtgttccagtgcctcgcgggcgtgatgttcttcttcggcaccttcttgccacatgcttcgcgcttcagcctcgccatccaagcgaacctggactgtgaacgagtcctcatcgggtccgtcctcattccacgcggcaatgatcccacgggcctcgtctgcgacctgactcaacttcatcgcctgcccgacagccccgagagccggaatctcgaacacccagatattcgcctcagccgagacctcacgatgggcgatcacttcgtaggtcgtctcaccttctactgtcgtgtccattacttccactccttcggaattttcacgcctgctcgctccagctgtgccaggacaccaactgacgtcagctggtgtcctgctggtatcgatacgcgcccggctccgccggggcgtccccagatttcatggcttcccttggcgttccgcagacgggcccatccttgagaacggagcagcttgaggacgtccttagttttctgcggtttcacacatcatagtatagccccacttaacttgtaaactaagcccctgtttacattttagttggtgcatgtgatccctgctcttatgacgtcgcccgacctggcgccttagacatgcactgttcatcctcaaccacactcaccgtcacgggtccgaaggcgaggtctatcaccattcgcatcgatgaagttgaagcaggatcgtccgcatcacgcactgccgatccggacagacgccaccggccgtaccgactgtttacgatctgccaccgcagactgctgccataaccgctatcacctctgatagtacgtttagtactatcagaggtgattcaagattctcctgtcgagcagccctacagtcacgaagtcctgcgatcgtcatcgcttaaggcagacggatggccatcggggaccactcgcaaagcaggggcgatcagcaacagtgatgtgccatgagcaagtactggtgcaccggctgtttactccgcccctagataaaccacgggtgcaggggtggacaccacaccatgaccgatgtggtgcccaccccatggctcacaggcaggccctatcgccgggagcactgctgcagatgaggctcagtaacctgccatgtctcacctggggccaaggt

SEQ ID NO: 146 - DNA, 1057 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccc

SEQ ID NO: 147 - DNA, 1057 bp, Propionibacterium acnes; identical to SEQ ID NO: 146

SEQ ID NO: 148 - DNA, 1057 bp, Propionibacterium acnes; identical to SEQ ID NO: 146

SEQ ID NO: 149 - DNA, 1055 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagccccgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcc

SEQ ID NO: 150 - DNA, 1055 bp, Propionibacterium acnes; identical to SEQ ID NO: 149

SEQ ID NO: 151 - DNA, 1055 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcc

SEQ ID NO: 152 - DNA, 1055 bp, Propionibacterium acnes
cccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcc

SEQ ID NO: 153 - DNA, 1057 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgtggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccagcaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccc

SEQ ID NO: 154 - DNA, 1055 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgtggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcc

SEQ ID NO: 155 - DNA, 1057 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctggcgtcatctcgtctcttcccggtacgtggctgtccatgttcacgggcaggtacggcaatgaggttcccgcacacaaacctctaccaagcatacgctggcaagcccc

SEQ ID NO: 156 - DNA, 1055 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaaacatacgctggcaagcc

SEQ ID NO: 157 - DNA, 1055 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagccccgcgcgccgcagtcgcgcctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcaggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcc

SEQ ID NO: 158 - DNA, 1055 bp, Propionibacterium acnes; identical to SEQ ID NO: 157

SEQ ID NO: 159 - DNA, 1055 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgcgctccacgtttttctcgaagtcgcgtcggctacgccccgggtagtgaggcatacctccgttacgtaagtcagtgagagctttccatacggttgcttcccggcgcgaggtgagcagaaagcgccagctgtccagtgacagactcgccacgatctgatcaggggtcgcatcgcgccccgcgctccgcagtcgcgcctcggccctgtcgacgttacgcgggaaaccaccgacccgatatctcggggattcccaccaacaccgtctgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcc

SEQ ID NO: 160 - DNA, 825 bp, Propionibacterium acnes
cgcacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgtcc

SEQ ID NO: 161 - DNA, 825 bp, Propionibacterium acnes; identical to SEQ ID NO: 160

SEQ ID NO: 162 - DNA, 821 bp, Propionibacterium acnes
cacccgccgcatcgtgacctcatcctcacgctgccgatcaccgtcaaccagatggtcagccacgatggtgttcacaccccatgactcatgcagttgcctggccaaggcgcccaacacctgctgacgcacctgtgacttgacgtcatcatcctccagatcctgtgtaccaaccatcacggaggccaacacatcactgcgttgctgaaccagggtgttgacgacgtcgacatcgtcgatacccatgggattgttggcgcgcgcggccacggcatgaaacgtgttggactgcaaattctcgaccagaccacgccgatagtcgttgaactgggaggtgtcggcaatgacaccggtcatgatgtaggccgacccctcggacaaggccctgtaggactcgtcgacgaacgccaccaaccccggccgccgccggtaaagtcgacctgcttcctcgtcagccagcaaccatgacagtttttgccccatatgtcctccttgctgacatgacctcgaacatggtaaactttccgtaggaaaaacggggcaagtactttcgagcggctacctcggcccccggtgggctgtccagccttgtgcggaccgaagccgggggattccttatgtttgcggcaatgatgccgctgcaccccctcatgccgtggtgtggtcctttccccgtgtgcggtgtggtgcgtcgttgactggtttgtggccccgagccttactctgaccggtaggagaacggtgtggggtctacggatagcccactcggctcccggtggaatgtccaacagggtagggttgatgagttggtccatcaggaccgt

SEQ ID NO: 163 - DNA, 769 bp, Propionibacterium acnes
ccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcc

SEQ ID NO: 164 - DNA, 603 bp, Propionibacterium acnes
accagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgcacccgccgcatcgtgacctcatcctcacgtgcc

SEQ ID NO: 165 - DNA, 599 bp, Propionibacterium acnes; identical to SEQ ID NO: 100

SEQ ID NO: 166 - DNA, 599 bp, Propionibacterium acnes; identical to SEQ ID NO: 100

SEQ ID NO: 167 - DNA, 599 bp, Propionibacterium acnes; identical to SEQ ID NO: 100

SEQ ID NO: 168 - DNA, 599 bp, Propionibacterium acnes; identical to SEQ ID NO: 100

SEQ ID NO: 169 - DNA, 599 bp, Propionibacterium acnes; identical to SEQ ID NO: 100

SEQ ID NO: 170 - DNA, 599 bp, Propionibacterium acnes; identical to SEQ ID NO: 100

SEQ ID NO: 171 - DNA, 599 bp, Propionibacterium acnes; identical to SEQ ID NO: 100

SEQ ID NO: 172 - DNA, 599 bp, Propionibacterium acnes; identical to SEQ ID NO: 100

SEQ ID NO: 173 - DNA, 599 bp, Propionibacterium acnes; identical to SEQ ID NO: 100

SEQ ID NO: 174 - DNA, 599 bp, Propionibacterium acnes; identical to SEQ ID NO: 100

SEQ ID NO: 175 - DNA, 599 bp, Propionibacterium acnes; identical to SEQ ID NO: 100

SEQ ID NO: 176 - DNA, 645 bp, Propionibacterium acnes
ggttgatgagttggtccatcaggaccgtcccggtggctgcgtcaatgatcgatatttcgatgatgcgcccgtccaggtcggtggtttcggtgtcgaggatgactccgactccgggttctaggagttgttcggggatccaatgggtggtcatcgtgtggctcctacagggagtgtctgggtcgggcagcggtgcaatacccgcgccatagcggtcttctctgcggcggtgacccacagctggtacttcattttgacggcgatttggcgggccacatagtcgcatctgtaggccttgttagggggtagccaggtcgctgcatccctgtctcgtttggcctcattagcgggtccgtcgacagccagcaagttcaacgggtcgttggccagggcggtgcgttgcagcggtgagagtttttgcgcgccggtaatccacgcgttcccgagggctacgacgtggtcgatttggactgttgtcgaggtgtgccggccgcgccgccaggcgagtgtggacccggtgtaggggtcgtggagtcgcccggagacgaccacgcatcgtgatccgggtttcaggtgggcctcgaccaggtcgcgggcaagggcatcgttgcgggtgtcgcatccgttgtggccccaggggcgggtcaa

SEQ ID NO: 177 - DNA, 588 bp, Propionibacterium acnes
acaaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatct

SEQ ID NO: 178 - DNA, 588 bp, Propionibacterium acnes; identical to SEQ ID NO: 177

SEQ ID NO: 179 - DNA, 586 bp, Propionibacterium acnes
aaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccatct

SEQ ID NO: 180 - DNA, 586 bp, Propionibacterium acnes; identical to SEQ ID NO: 179

SEQ ID NO: 181 - DNA, 584 bp, Propionibacterium acnes
aaacctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccat

SEQ ID NO: 182 - DNA, 582 bp, Propionibacterium acnes
acctctaccaagcatacgctggcaagcccccctctcggccccaccacaacatcaattgctgactcgaacacctttgaggcagcgctttcggcttgcgcaaccccacccacgacaccgtccgcttactactcgaagctgagggattcagaccccacctacaccctcgattgtgaagagcctccaaagcccgatacaacgtctggcgagacaccgtgaacgacctcgccaccgcagcaacgcaccagcagcgcgggatggcttggtattagcccagcgcagggcccccaggcaccagccctaacgaccccgcacccgacgtggctagaggataagccgcacgggaggactccatacccgccgactcattccagcccgccaccagccgagccatatgatcaaccgcccgcggtaaataatccagccactcacgccggtcgtacaaggaaccggccccgctccaggcgtgtgcccaggatcgccacaacacgtcgagctcgaccaccacgcccggaatagattcccactccaaatccggatcagcggccgccacgtaccagatcggccacatccgtcttggcccat

SEQ ID NO: 183 - DNA, 592 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacg

SEQ ID NO: 184 - DNA, 570 bp, Propionibacterium acnes
accagatcggccacatccgtcttggcccatctccagcccgccagacccagggaggccatcacctcatcgacgccgcgccgggtggtctcatcaaccccgtcaaacagctcgggccacctcgatgatgccgtccgtgaacgatccagattcatgacatgctcctcttcacagatgccgacgacgatcaggccgtggccgtggcaacggggtgacctgccggcgcggctcacgacgttgagccggaaccacacgagacgcaccagtgtgctgcgccgtcttgagtcgggcgctgtactgggccctggcgctgtggtgaacagcccgacgaagcaccgaccgccggctgtcctcatcgccagggcgaggcatggggcgcggcatggtgcgcccggtagcagcatccatgagggtgatccggtcagccaaaatgccgagccggttttcccacttccggggccacggcaccagcaggtcacgctgacagcccacgccgtggcgtcggcagtccacaacattttctcacggccaggatgcgagtgcagcagctccaccggaacaccagcatcacgc

SEQ ID NO: 185 - DNA, 570 bp, Propionibacterium acnes; identical to SEQ ID NO: 184

SEQ ID NO: 186 - DNA, 581 bp, Propionibacterium acnes
cccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagccccgcgcgccgcagtcgcgcctcggccctg

SEQ ID NO: 187 - DNA, 48365 bp, Propionibacterium acnes
agcatctacggcgaaggccccgactgctccgtactcaccaaccgcatctacaccgaccagcccaccgatgtgaccgctgcactcgccgactacggcttcaccatcgacaccaccaacacatccaaaaccatcctcacgctcacccgcacagccaccatctcccacctgctagccatcctcgatggcctaccccaagctgaggggactcactggctcaacactcaacccgacctccaccacatcaccctcgacgactccaccaccggctgggccaccaaccgcaccgacgacaccgacaccggcgtctgctacgacaccagcacccacaactggcagatctgctgacagcatgacgggcctgcccttgagggcaggcccgctaccacctgactctccctccgaaaagagggaaccacctctcggccagagcggccgagcttgagagatgagagcaataacgttcatggtcgtctccccgagtggtggggtgcgttacttagcgccgccacacggtgacggtgtcagtgccgacaaacggagacccctcgggcccacgaatgaacggggccacccactgcaggcgtcggagactgcgcttgggaccgtagggctggtgtgtccaatgcccccgcaccacatgacgggtcgtcaaccgcctaccggtcgcatcggtggtggtgtgcacctgcctcataggccgcatatcgaccacatcgtccagcgtgtcgtctccgacgaacaaccttcgccccggcggcgaatcggtcgctgtacagctagagcccgcaagatcgtcacaggagtcccttccctcgggttgcgcctcccgttttttgtactaccatattggtatggccatcgagttcactgatagtgccggcaagcacgggttcactcgcgaggacgcaatccacgcgatgcagacccctgaggtcttcacgccccacttcgaccactcccgtaccgacggcccggatgtcgcggcatgggttggtcccgcgaggggagggaggaccatcgaggtgttcgccacgttggttcccccggacacggttaccgtcttccactgcatggacgtgcgagccacgaccatcgccaagctgaatggagagcgagcatgagcaccacccctgccgggttcgacttcgacgctctggccgagtgggccgagagcgatgaggcgacccacaccccgcaaaccagccccgtgttccggggcaaggacgccgcgcgcgccagccgcgcattcctcggccgaggacggcccaccctcggcgcggaccacgccaccggcgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcctgctttccggtgctgtcatgagcgtctgacaacagcgacacctcggggcagccgacggacagtcctctggctgccgctctgatcccatgcccacggcacgaaggtgtcggacagctcggtctcgtcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgccccgcctggtcctccagccacgacaacgcatcccgaaacagcccgacgtcttccaaagctaaaccacagtcgtagccgcccttgtcccccaaccgcacaatctggcgctcccggtggcctccctcgtcgacctcgatccacagtttcgcgtgcatccgctggcctcggccctctgacaggatctcggtgagcaggtcggaggcttgtcctcgcgcatcctcgttactgcgggggaattggagtatgtgggaggaacgacgatgggggaggttggtgacctcgtgacgcagcaggttgcgcttgtgcatctgctgatcgagacgctcgggctgacctgttgacggggttgagccgtggcgccgcttcctcggcggggtctcgatccgttgctcttccggcggttcggcgtcaggttgtggtgcgcgatctcccctaggacgggggggctcgccacctatatccgagggacgatgagacggccttccacgcttgctgcgtaccttcgcggtccggcctttgcgatcatgccgacgccgcggcggggtaacctcctcgccccgctccaactgtgttaacgcctcgaccaggttggtgccaggcttaagccctttcagcacgaaccgcaccaggcgggggtctcggccgattcgtcgggcaatctcggcttggctccacccttcggctaacagggtgcgcaccaagtcctgagcccgattgtcacgctcagtcactggtcgcctcctcggggagtcctacttgctcggcctgctctgatagagcagcccgctccgatccggtctgaggcgcttccaaagggcccggcaagacacctttgacacgcagccgcccgtccttgccgtcatcgccgcccccctgggccacagggagcgcccaggggggcacgttgctggtgtagatggcgtcgccgtggatagccagcagggtgcgggagttcatgcgtagtgctcctcccttggttgtggcgttttttccggtggtggggtcggcgatgggtgtgttgagggtgcgtacgcgggacagggcccagatgcgggcggcgatttcggggtgccaggtgtcggggtcggggcggcggcgggcggtttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggtttttgtctgcccagcgtttctcggcgatgtcgatcatgtcttggatggttttgacccatcctcggatgggatcgactttggtcagtttgatcccttcgaggaactcgatgggctgggtgatgggcccatctggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcggtagctgggcatttcaccctcccctatctgtcaaatgagctagacacagtgtctatttaatttgacgcaaagtcaagtgtgctagacgcctttgtgtggatccgcccgcccagacaggcactcacgtctcatgacccgccgcgacgtcttaacgaaaccaaaccgcttatagaaccgctccgcagcgggcccggagggcttcagttcgagggtgagaccgtgctcgtcggcccattggcagacttgtgtgaggatctgtgagccgtggccttgagtgtgggggacggcgtggacgcacatgagcatggggccgtggcggcgcgctggcggggccacgtaggctccgccatgccagtccggtgtggtctgccagcttcgccatgtcgcggtacgccagtggtgggcttcgagggccaccatgatcaccgcgacgacgacgagcgttgcggccccgatcatggccagctcaccctgaccaggccagttcccgcagatgatccagtctcttaacgcccagatgatcgcggcttccacgcctgctgcgatcgggatgagcaaggcagaacgaaggtgtcctgccatgatctcggtgatctcgctgcgatgccatgacaaggagaattcccacgactcttgaatcatgctgatgtgtgaacggcttcttcggcttcgccctgccatagtttctccaaacgacgctcagccagctcgtcgggacacggcgacagcctgccgcactcggagcagaccccgaagtggcgcgagagagtgatgaccggctcgtcgggagcatgaaccgactcgatgcccgggtgctgctcatcggtgagtcccgaagcgtggctgatctcgatcagacggaggtggaccatgccgtcgtagctgtcggctctctcgacatggaacgggtaggagccgtccgcggtgtggcctgcaaccaggtccccgatcttcaactggctggcggtcatggttcgcaccggcggcagcggggtccgggtcgcgttgatcctcatggtctctccttgcttctgcgccttcatagatgaaggtgccacagccggggttgatgtgcggaaccacagccactttttcaataaatccatcaccacggtctcaccccttcccaaatgtgtaaaccatgatttacacatttggggcatgatcgaacccacaaccatctccaccacgccccgcgtggccatcatctcccccagcgggccagcacggttctggggcgagcctcccagcatcgcactgcgccgacacggccggtcccccatgaggtcccttccttccggggccctgctgctggtgtgggacgtcaccgttttgaccgggcccactctcggccaccgcgtgcgtcctctcagtaaggacgccgagctgactgcccggcgctggctcgaccaggtcgccgacaaccccggcttcctcgacacccttatcgaggccgcccgcatcaccgatggatggcatcacgcgacgcctccgcacattcaggccccttaccggacccttcatcagtgaacggaggtacaacgacatgaccagcgacattgacattgaccggacccacaaacccgacgaccgcgccgaggctcctctttaccggtcctgggccaggagactcgtgcacgtctccgggatgccctggcgtatcgtcgccgccttggccggggtctcccccacctccatgcaccggcttctattcggccgcaacggtcgacccgtggaatggatcggcatcaatgatgctcgcgccctgatggatatcggcatcgatgatctcgcctcagcgtccaccgaccgtatcccggcccgcgaatcccgcgagctgttggtagccctgcacaccctcggctggaccgatgagcatctaagccgctggctgaccagttccgacctcgacctggccaccacccccaaggccctctacgtcacccggctatccgccgcccgcatccaggccacctacgacatgctcatcagccagcccgtccgccgctgcggccacccccgcaccccgcctatctcgtcccagactccggttacctcgccccagcccgggcccgaggatgccgaaacgttccagcccgccctgttcgagctagccgactgcgcatgagaccccacacaaacatggttgaatcgaagggctcagccagcagccagttaccaggagtccccgtgcgtctataccgcgctgttcttacccacaccgacatccagatcaccgtccgcatctggagcaccaccgaccacgactggacctggactcccctcgacacctggacccccgacccgaccccgaccacaccagcccaactggccgacgaactccaccgacacggatggaccacccccgaggaccccaccaccctcaccaaggtgactgtgatccccgagaactggcaggccctcgtcgaccacgccctcgctgcccgaaaccaccaagccaaccagctgcgcgtcgccgagaacatcctcaccgacatcctcggcgacgccgccgacgctggcctttccgtgaccttcctcgcccaggctgccggattgtcccgagctgccttctacaaacgcagcgctaagaccatcaactctatgaggcacgccgaccagccgcgcgaagacccctcccagctcacccgagccgagaaaacagcactcagcctgggcgacgagtgatcctcacacctcctgcgacagcccggccgtggagccttcccacacgtgtctagccagcactgaccgggaaaacctattcgcggcaccacaccgggcccactcaccagtcacctacacccccgactgcccctcgcgaagacccaaccagcgaaccaagtccccaatgcgcccaccacgatcagcacacccacggcgaccaccaggtgggaagcactaaccgaccccaacaacccaagatcaaacaggccctgcccgggaacgccgagcagcccgtgatcgcgaagccatgctccgagatgaccgatgattttaggggccatcttcttcagcagggctatccctccgataccaacaacgatgaaggcgaggatttcttcgcatccgttgtttccttctccggtggggccgttcatgctgccttctcggggtggacggccagccagccgatgaggttgtcggcgacctgtcctgaggtttcgatcagttcgacctgtccggcctgccatgcccgtgatgtgccggccagcaatgatgccggggcccctgctgcgcggctgagagaagcgacttcagtcaaggcggtgcgtagctcctcgatggcgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgccttgccttcttgtcagtggcgcttccgagatggggtcagtgggcgatggctaggccgatgagggcgccgctgcacaggctgggcgcccagggaaggaatcgggtggtgtggtgtcggaaccgatcgattagggcatatagggcgatcagagtcagcccggcgatgaccgtggcgtggatcgtgtcgatgccggttgctgcggccggggctgcccacagtggtgtgatgcgcacgtcggagaagccgaagccgcctcgggagatgacccagacgatcatccacgctgcgaagatgatggcggtagcgatgacagcacgtatcgccgcagtatggtccgagagggcggtaacgactacagccccgatccatccggcccatccggtccacgctaggactgccggtatccatgtggtgatggcgtcaatgacggcaacccatgccccgatggtggctagcagagcccaggccggccaggtgggtgctggggcccacgctacggcggcgatcatggttgtcgcagatgcagcacagacagcgatcaagcttcggagactgtaggtgtcgcggtaggcgatcttgtcggggctggcggtagctggttctggcaggacgcgggtgagggcaggccaccctgcggccgcaatagccatcacggcgaccacccacacaatctgttgcatgggtctcatcatggcccatcaacgccgaaaatgggtggccgacatgggttcactcgtcaagaggtgtacgggcggccgtggcttctcctgcgccgagcatgagggtgccagaatcctcgccagccgattcccagtcgacgatgacctggtcgccgtcaacgctggattcggcgatggtcacccattgcccgtccatgtcgatgagcatcccggcggccagctctgtggcggcaaccgggtgggctgggctgtagaggaggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgagccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaacccgccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccaccgcggtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctttcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccaatcgccgacgccccttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacagatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcattgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcagtattcccggtcagcatggcggttaggaagcctgaagaggcttgggcggccgggtcggcggtgcgaagctccgaggtgtctagggtgggggccgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggatgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaattgatctagctatgtatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggttggggctgatcctggccatcgacgggctggtcccggcgccgcctcgacctggtgccccgctgagcccggcccagaggtgggctcggctcacccaccgtcccacaggagcggccgggcgtcgccgggatttgcgttgggggttggctgttctcgtcggcgtcgtgctgtttatgctcaccgggtgggtggctgcgctggcgttgggccccatcattgtgttgttggcccccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaagtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgaatggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtgacggcgcccaattccgtcgtatcgccgaagcctccggtatcgacccgcactcagagctgaaagtcggccagaaactgatcctgccggttcccgagaacacggccgcagttcattcggttaaagcgggggagtatctgtgggagatcgccgagcactactacggtgacggcgcccagtaccataaaatcgctgaagcttccggtatcgatgcccattccgatctagccgtgggccaaaaactcgtcatccccgggcccctccgccacgacgccacgccgccacaccactcggcgtcgacccacgcgaaggccgccaccccagcccacacgcccacgcgacggcctgcgcctgcccacaaagccacgcccgccccgacgccggccaccccaactactccgacccacacggtgaccccagctccggcctctgccggccactcgaccagcgacgagcacccactccatacggataccgccgcagcggacaaggccagcaacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccaggttcgcgtcgacaccgaccaacccggcaccgacacccccttccccatcgacgacatcgacccgctgagctccgaccacccggtcctatccatcatcggccaccccgacatcacaggtgccactggaaccgttgggcgctccccgtggcgctgccaacagttggccctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggagacttggggctggcccggtgggcgctgacccaagggctactggtgtctcccgatcatgaggacctggtcgccggttgtctgcgcaccgaataccaggccggcaacatggacaaggtcgccgagctagttgatcacctgtcggctaccgcacgccgactgggcgtcgacctcaacgaggacaccacccggatcatcgatacggtcacccacgccgacaggagagcatcatgatctcccctgcactcatctccgtcaggaaggtccctatgcaccattatcgtcttggtatcggcactgccctcatcgccgtagcagccctcaccggctgccactcagcaggatcaacgtcggctcccacgccgacaccgagtacccccaccacaacatcgacagcatcggcgagccgcacttctagcccgaagccatcggcgggggccgtcagtgccgccgaagccgaaaaggtctaccgcaccatccacaaaaatgacttcgagttggagaagatgggaggcctagcccccaaccagccggccccactcatgatcaccaactacgcctccggccaggccctcaagagttacacgacgttcaaccacaaggtctacgacctaggcatccactggaagtcagggacctcaaccatcacggccgtacgcgagaagaccggcgatacgactcatcccgaagcggctatcgccctggaatcatgcgaggaccacagctccgtccgaaccgtggaccgcaatggaaaagccagccatggagtcatcatccatctcgatagttggtatgcccgcgacaaggcaggcaccgtcaagatgatcgcacgtaacggagtggaggttccctcatgcgacgtcaagtaatcaccgccggccttctgggcctggctatgaccaccacggcactccccgccctcgccgatagaggcggtatggatggaaaagtggacactgagggtcccgggtacgacgtttcggtagacgtgtggaatcattcccaccgcggcagcacaccccaccacggggactcgggtcatcgggataaaaagcctcaccgcgatgaccatgaagccacagccattgacggaatgtctgagtctgatgcctgggctgttgaccatgggtatggctcagcagacagctatgcgtgccgaatgatgaagtcatacctggacggggcaggatcggcagctctgtccccggcagagcgtaagagccagaccgatgacttcacgaaaaaatgcaaggcagacccgtcgggtaaagctgccccgcctgacccggcccaggtgggccggcacgcggccatgaagatggtcctgcctggggcccgaccagtcattgcccctgacccgagtctgaaccggtggcattcggcggcggtgggccaggccttgtggttgtccgtgaatgacccgactgctaccaagcgtgaatcgttgacgttcatgggtcaggctgtgtctctgacggctcgacgtaacgggctgtcgttcgagatgggtgatggtcacactgtgcattgtgatgccacaaccccgtggtcgccgtctgtggagccaggatccccgtccccgacatgcgggtacacctaccagcaggcagccccggaaggcggttatcaggtcaccgcaatcacgtcgtgggatgtgacctggtcggtactaggacacacgggcacggtccatatcgagaaggccggtgggcagatgcttccggtcggcgagttggagtctgttgttacacggcgatgactcctgatagtccgacgctgtatgaggtgttgggggtgtgccctgatgccactgatgaccagatcaagacggcgtggcgtcgtgccgcgaaagcgacccaccccgatgccggcggcgacccccaggcgttcacggccgcccagcacgcctgggaagtgttgtctgacccggactcccgcgcctcctatgatgccgccctagcgggggaggatgatcccgacgtagaggccccagacaacaccgtcgaccccttgaccccctcgtggtcgtggagtgtctccttcatcgatgccaccccgcggctacgccacacccggcccggcacgctcgccgcgatcgtggtagccgccgccggggtcgaggccgggatcggctggcatgaggcgttggaggccctcgccccctctcccgggttcgtaggttcgtggtggatgacctcggttccgctcgtggccggagtgacatggctcgcggcgatcacggggatccaggccatcatggccgggatcggctggctggggtggggctttatcggtgccgcctgcctgtggggacacccgtgggctgtggccgtattgggagccggatgggtggcctgggtagccgccgcagtgtggtggtggcgccgacggatggcctggcctgcccgcacctgccgggcaggaaacatggtcgacatgcccgaggttgacccgccatggatggagccggtggaactggtagcagaactcatcccctccgtgcgggccatgtggtctcctgacgggcaaacggtggctgtagtagccggtcggcgggtagcaaccttagggatgccgatgcgagggtggcgtggcatcgatatgcggggctggaacccgatcggtgccgacaccgcgtggatcgttgaccagataggcggctggctggccgaccaagacaaaccgctcaccatcgacgggcgcatcttgtacgagacctgggacaggctacagacagttcgtcctcacagctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggaatgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcactattgacgggaaagtcctgttcgagacctgggacgggctgcaggcagcccgtcctcacagctgagaaaaaattttgggggccgttccgcacatcgcggctctctttcacaccttcaagggtatgaaggaagtacagacaccaaaccgagctgagaactgtgcagtacggtgtgttgagccgcatatcacccatcggatgggccataatgatctctatgaggtctccccgcaagccataccagaagatccgtcgcggcccgaagccacgctgcgaagagcccgtcaggtccttgacgtgttatgtgcctcagtctctgatagatccgatcgacgagatggcgtggcagttggagatttcgaagtccgatctcgtggggtggtcggctttgtgcaccctcaatgtggtgcgcagggaccgaggcgaggaccccataccgatcccggagtatctggacaaggccgtgctcactgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagatctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctccctgagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggctcggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcgatgctgaggtgggctctggtgaaggtgtcgaggagggcggggaacccctgtcgattttgtccacccacccctgtcgattttgtccacccacccctgtcgattttgtccgccaagtattagacaaaccattagacagtgaattagaccctgggtcgcgtcagcgtgttagctcaccgccgcgcgcgcgcgcggcggccgagccgccgaagccaaagaaacccacaccaccaacgcctgaaccagcagcccccgcttcagacagtcctgtgtcagcgcacgctgatgaggctgccaagttggcgtggcagttcgtggggtggtgtcctcagctggtaggggcaccgaagaaggtacgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggacgtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcaccgcgatgtgccaaatcgtgcgcaccgccctggaggccgacctggccgccggaacccggtgggaggaccgatgagggcgctacgtcgaaagatcatggtcgtggtggctgtgttcaccgtcgcggtagcggggctggcgttggccaggtcgttgccgtttgccgacaggtctcagccgccgacgaccagaaatgccacccaggcggccgcaaccggtgcgggggctgcggcgggcgcgctcaaccgtctgccagtcaaaggcaaagcagcgatgaccggatacacccggacccaattcgggcaggcgtggaccgatgacaccgaccgggagttgacccgcccctggggtcacaacggatgcgacacccgcgacgatgcccttgcccgcgacctggtcgaggcccacctgaaacccggatcacgatgcgtggtcgtctccgggcgcctccacgacccctacaccgggtccacactcgcctggcggcgcggccggcacacctcgacaacagtccaaatcgaccacgtcgtagccctcgggaacgcctgggtcaccggggcccaacacctcccggcaccgacgcggcgcgctcttgcgaacgacccactgaacctggtggccgtcgacgggcctgccaacgaagctaaacgcgacggggacgcagccacctggctaccgcctaacaaggcctaccggtgcgactacgtggcccgccagatcgcagtcaaaacgaaataccagctatgggtcacccccgcagaaaaaaccgctatggcgcgggtactagaccgctgtccagcccagacacttcctaccggagccccacgatgaccacccattggatccccgaacaactcctagaacccggagtcggagtcatcctcgacaccgaaaccaccgacctggacgggcgcatcatcgaaatatcgatcattgacgcagccaccgggacggtcctgatggaccaactcatcaacccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgagacctggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggagtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcagactgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggcccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgtggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagccgttgcatgagacgacgcctccgcccgccacaccaacggtcaccgccacggccacggtgaccgtgaccgtggcaccgaaacccaagccaaagcccaaggccaagccaaaggtaaaacccaaaccgaagcccaaggcccattcatgatcgcagtgcccgatacaaggtggagcggcccacaccaagctgggccgccaccttcgttttcgggacaccctcggcaacgaggcggcgagcgcgggcaagctggccctcgctcaatgccggtttccggcctcgatagcggccctgcttcttcgccaccgcgatcccctcggcctgtcgttcatggatcaacgcccgctcgaactcggccaaggcacccagcagatgcaacatgagctggctcaccggatcagcggaccccggcccatagacctgacccccaaggagccccgatctgcgccgaggcccgcaccgtccaccacatcagccccgacgatctcgcgacagcccccacgttcacccaggtgcggccccggctggaggatgtggtggccgatcgggtggtcatggcctggaacgcctcgttcgaccgggagcgaatcgaagcggaatatgccctagcgggcctggatgctccggcgtggccgtggtgctgcctgatgcgtttagaggcgtccgtgatggggtgccagtggcgtcgactagacggaccccaccggggccttggtgatgtgatcgccgcccgccgccggcttatagcgttacaagagatgcgggtcgccaggatgacgagtgaggggcaataaccaccaccccgaaaggacatagatcatgagtgagattcatttgacgggtgttcgcagcggttagagggcagtggcttcgtcgatggtggtgcgggggagttggtagaagcgggcgagggcgtcggcgtcgaggtgggggtccatggtggaggcggcgatgatggtcccgtagagggtccacgtggtttcgttgtcggtggggttgtcggcccagtgttggcggagttcggagaaggggtggtggttgaggaggaggcaggctcccatggagtagtcctcgatttcgtcggcggtgaggcggttgatgtggttgatgtcggcgaggacggcatcgaaggtgtcggcttcggtttcggttggtgcgtccatgtcaatgttcatgggggaagccctagggcgctggtgggtgttgtgggggcttgacacggatgtggtgggtatcgtgggggtgcaacttctgtgggagttgttggctttactgagagatcccccggctgtggtggctgggggatcgttgtatgtgggctggggtttcccctcgcaacacgccgatacgcatatatacagatacatcgatgtacatgtgtaatgatgtatttatgcgtagtatttctattgttaacaccaagggtggggttgggaagacgaccacggcggtctacctagcaacggccttagccgctcagtaccgagtcatcttgcttgacgccgacccgcaaggatcggcgacgtcatgggctaccgacgctttcgaagccggtgaccagttggacttcgaggtccgcccggctaatgcccccattgtcaggcgctgccgtgacatcgacgccgacctcgtcatcatcgacactccccctggtgactctcagacgattaccgcagctctcgacgtcgccgatgtggtcatcatcccgaccgagtcgggggacctggacatggatcgagcgctaatgacctaccaggtggcccacggcacgcgccgggccttgctcttcaacaaagccgattggaccaggcaataccgtgatgcccacgacggagccgccgccgtagagggtctagacgttctcgatgcgcaagttcatcggcgggtcgcctatcggcaagccatcgggacccgaccagacgacctcggagagttcgcccaggttgctgcccagatcaaggagatgctgaagtgagtaagaaccgcaaacccaccgccgcagacaaggccagccgctacagcggccagatggcggccagccagggggccagtgttgccgaaaccttccagtcagccaagaccccgattaccccgttcaacgtcaaactgcctaccgctacccatacggcgttaaaaatgaaggccgttgccgaccacaccaccatgaacgaccttttgcgcaaggccctggaacacacctacggcttcccttacgacccctaccagtgaaggacgagacaccacgccatgacctgggagcggctttagctggtggtggtgggctgggattgtaagggtgttgcggggttcgtgttggtggtgggtgttacaggtgtctagcagggtaggttggtgtacatgatgataggtgtatgagtatctatgtatctttctatcggggcttatcggtagatgtcgcggcggtgaccgatggacagggcaaggatgatgaggcggtcatcgttgagtgtgcatatgaggcgataatcaccgatccggtagcgccacagtccagaaagatcaccggtgaggggcttgccgtggcggcggggatcgtcggtgttgtcgatgtttttcgtgatccagccgtgaatgagtttttgggtgtagcggtctagctttttgaattctttatcgaaccggctagtggtttcgatctgccaagtcataggtcacactcgtcccatagctcgctgatgggacgagactggtagttgtcgttggcgtagtcggtgagtgcctcacgggctacttgcagatcgaactcgtcggcgatgcggtcgaagagggcttgcttgaaagcctcactcagggactgcgagtgtaggtgggcgtaggaatcagctaagcggcgctcatggtcggttaaacggatggaaaaactcatgatgtcacctcgtaagacgtctatagtacaatgtactacacgagggtgggggagtccactcctcgaccccgcgtagtacgtatcaggggtatggagattcaggcggcgggaacggttcccctgtcggggggtgaggggcgaccggggtgagccggtcgccccgtggggctcactgtgcggtgagctgcaacgcctcggcaatcgcgtgggaggtcttcgcgacgtgctcggcggcagcttcaatcgcggcgccgtctgcttccttcgcccagccggcaacgtacccggctgaaatgggtgcagagtccaacttcccctcaagggcaggcccgtcatgctgtcagcagatctgccagttgtgggtgctggtgtcgtagcagacgccggtgtcggtgtcgtcggtgcggttggtggcccagccggtggtggagtcgtcgagggtgatgtggtggaggtcgggttgagtgttgagccagtgagtcccctcagcttggggtaggccatcgaggatggctagcaggtgggagatggtggctgtgcgggtgagcgtgaggatggttttggatgtgttggtggtgtcgatggtgaagccgtagtcggcgagtgcagcggtcacatcggtgggctggtcggtgtagatgcggttggtgagtacggagcagtcggggccttcgccgtagatgctgatctccacgctggtgccgtggtagtgggcttcgtaggtttcgtcgatcatccatgttgtggcccagtcggcgtcgacgagggtgtagggggttcgggtagtgggaagtccgatgtagggcttggtcaccatgttgacgtgtgcggtgtacttcatcgtcgttgattcctttcccgatctctcgttctgcttataaatatatagcccgatagacagactgtcaagagtactggataaataatctaatacgcttgacttgaaggatagttgagagaataactcacatgtgagatgccatcagcggcgcagaatgccccctcctggccccttgccgccccttcgggtggccaaggctgtaaaccgcagcgatacaggcttacaggtgccccgaaggggcgcctatccacgcgctcacccgacgccgaaggcgtcggcaggccctgcccgaagggcagcggctgcccccc

SEQ ID NO: 188 - DNA, 53136 bp, Propionibacterium acnes
ggtgagcgcgtggataggcgccccttcggggcacctgtaagcctgtattgctgcggtttacagccttggccacccaaaggggcggcaaggggccaggagggggcattctgcgccgctgatggcatctcacatgtgagttattctctcaactatcctttaagtcaagcgtattagattatttatccagtactcttgacagtctgtctatcgggctatatatttataagcagaacgagagaccgggaaaggaatcaacgatgaagtacaccgcacacgtcaacatggtgaccaagccctacatcggacttcccactacccgaaccccctacaccctcgtcgacgccgactgggccacaacatggatgatcgacgaaacctacgaagcccactaccacggcaccagcgtggagatcagcatctacggcgaaggccccaactgctccgtactcaccaaccgcatctacaccgaccagcccaccgatgtgaccgctgcactcgccaactacggcttcaccatcgacaccaccaacacatccaaaaccatcctcacgctcacccgcacagccaccatctcccacctgctagccatcctcgatggcctaccccaagctgaggggactcactggctcaacactcaacccgacctccaccacatcaccctcgacgactccaccaccggctgggccaccaaccgcaccgacgacaccgacaccggcgtctgctacgacaccagcacccacaactggcagatctgctgacagcatgacgggcctgcccttgaagggttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactcccccgccctgagcagtacactgtactacacagtcattgaggatagaggtgacgtcatgagtttttcgatccgtttaaccgaccatgagcgccgcttagcggactcctacgcccgcctacactcacaatccctgagcgaggctttcaagcaagccctcttcgaccgcatcgccgacgagttcgaccttcagatagcacacgacgcactcaccgactacgccaacgacaactaccagtctcgtcccatcagcgagctatgggacgagtgtgacctatgagctggcagatcgaaaccactagccggttcgataaagaattcaaaaagctagaccgctacactcaaaaactcattcacggctggatcacgaaaaacatcgacaacaccgacgatccccgccgccacggcaagcccctcaccggtgatctttccggactgtggcgctaccgcatcggcgactaccgcctcatatgcacactcaacgataaccgcctcatcatcctcgccctgtccatcggtcaccgccgcgacatctaccgataagcccacaccacccccaaccaccaccaacccggtgcataaatacacatacagctatacacctatcatcatgtgcaccaacctaccctgctagacacctgtaacacccaccaccaccagctaaaaccgctcccaggtcatggcgtggtgtctcgtccttcactggtaggggtcgtaggggaagccgtaagtgtgttccagggccttgcgcaaaaggtcgttcatagttgtgtgttcggcgacggccctcatcttcagcgccgtgtgggtagcggtaggtagcttgacgttgaacgcggtgaggggggtcttggccgactggaaagtttcggcaacactggccccctggcttgccgccatccgaccggtgtaacggctggccttgtctgcggcggtgggtttgcggttcttactcacttcagcatctcctggatctgggcagcaacctgggcgaactctcctagatctgttggccgggtcccgatggcttgccgataggcgacccgccgatgaacttccgcgtcgagaatgtcaaggccctctacggcggcggccccgtcgtgggcgtcacggtattgcctggtccaatcggctttgttgaagagcaaggcccggcgcgtgccgtgggccacctggtaggtcatcaaggcccgatccatgtccaggtcccccgactcggtcgggataatgaccacatcggcgacgtcgagggctgcggtaaccgtctgagagtcaccggggggagtgtcgatgatgacgaggtcggcgtcgatgtcacggcagcgcctgacaatgggggcattagccgggcggacctcgaagtccaactggtcaccggcttcgaaagcgtcggtagcccatgacgtcgccgatccttgcgggtcggcatccaacaagacgacccgatcctggcaagacagggccgtggccaggtagaccgccgtggtcgttttcccgaccccgcccttagtgttgacgatagaaataatacgcaccataaatacatcattacacatgtgcatctatgcatcagtacacatatgtaccggcgtgtcgcggcaggaaaaccacccacatacaacgatcccccagccaccaccaactccgagatcttatgaagagacaactcccacaggagctacacccctcacaggagcccaccagatccgtgtcaagcccccacaccccctaccagcgccctaggcttcccccatgaacattgacatggacgcaccaaccgaaaccgaagccgacaccttcgatgccgtcctcgccgacattaaccacatcaaccgcctcaccgccgacgaaatcgagtgctactccatgggagcctgtctcctcctcctcaaccaccaccccttctccgaactccgccaacactgggccgacaaccccaccgacaacgaaaccacgtggaccctctacggggccatcatcgccgcctccaccctggacccccacctcagcatcgacgccctggcccgcctctaccagcttcccctcgacctcgtgacccaagccctcaccgtctaagcgccgataagcgggggagaggtagcgcactatcggctaaggaaccccacaaacaccaaacccttgtcactgggaagggtttggtgttatgctggtctcacaactcaacagaggaggtgagacatgggaaatgagtaccagaagtcgctcaaagtcctgttcaagaaactggaatctgagcaaggagcccgcatcgagacccggcgcaaaggatggatgatctacccgccggatacgtcacgaccagcggtcatgatccacaagactccatcagatcgcagagcatgggccaacatgctttccgaactgagacgctcaggattcaccgtctaactcagtgaagggggctggagctccagccccctttcaaccacctcccccggacaccacacaagaaaaggagaacatgatgtggcacgttcggttgtcgcttcgcgcaatcagcgaggacatgctgttcgacgccctggacaccctcgaccccttatccccggtggccacactgggccccgatgagcacaccggatcattggcggtgttcgtcgaggctgactcactgacagacgccatcgagactgcccgcacagccatcaccaacgcatgcaacaccgccaccataaccggcgtagaagcccgccccgaagacgaatgcttcgcagacgttgaccggcccctgttcccgccagtggtcggatacaccgaaatcgctgaaaccgcaggactctcacgtcagcgcatccgccagctcgcaggcaccgccgggttcccggcccctgtcatcgaaaccgcccaggggccgctgttccccaaagccgcagccgagcagtggacacgaacacgccagcccaaagcaggccgcccaaaactccagaccaccacctcataacacatcccgtgtgctgaacctgttggccggcccagcacacacccccaggggccgggcccagcccggccccgccccacacccagccgctccctgttgccgccgtggcgaaacgatcaggcgagccacgaccatcaccaagctgaacggagagcgagcatgagcaccacccctgccgggttcgatgtcgacgctctggccgagtgggctgagagtgacgaggcaacccagaccccgcaaaccagcccggtgttccacggcaaggacgccgcgcgcgccagccgcgcattcctcggccgaggacggccggcactcggctcagaccgcgctaccggccaggggcggtcacctcgccgtcaggtccgcctcgacgcacgcaccaacgcccgactcgacgcctacgcagcccagaccgtcaccagcgcctcccaggtcatccgcgacgccctcgacacctatctgcctgcctgatccaaccccaatccactcgggcgcctgtcagtgctggtgttctaggcggtggctggcatcgacggcatctgctgcaacgctataagcctctgcctggctgctatcacgtcgccgaggccccggtgtggcccgtctagtcgccgccatcggcagcccatcatggccgcttctaaacgcatcaggcagcaccacggccacgccggagcatccagccctgcgaggccatactcggcttcgatacgtccctgatcaaagggggcgttccaggccatgacgacccgatcggccaccacatcctccagccggggccacaccggtgtcctggcctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgccccgcctggtcctccagccacgacaacgcatcccgaaacagcccgacgtcttccaaagctaaaccacagtcgtagccgcccttgtcccccaaccgcacaatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacgatgatgggggaggttggtgacctcatggcgcagcaggttgcgcttgtgcatctgctggtcgagacggtcgggctgacctgttgacggggttgagccgtggcgccgcttcctcggcggggtctcgatccgttgctcttccggcggttcggcgtcaggttgtggtgcgcgatctcccctaggacgggggggctcgccacctatatccgagggacgatgagacggccttccacgcttgctgcgcactttcgcagcccgccccttgcggtcacgtcgacgcggcggcggagtgacgtcctcaccgcgcgctagctgcgtcaacgccgccaccaggttggtgcccggtttcagccctttcagcacgtagcgcagcaggcgggggtctcgcttgattcgtcgagcgatctcattctggctccacccctcggccaccagggtgcgcagcagatcctgggcccggctgtcacgctcagccacggctcaccccctcagggatgcctgcctgctcggcctgctctgacagggctgctcgttccgatccggtctgcggcgcttccagagggccaggcaagacacccttgacacgcagccgaccatccttgccatcgtcgccgcccccctgggccacagagagcgcccaggtaggcacgctgctggtgtagatggcgtcgccgtgaatggccagcagacagcgagttctcaacgctcctcccctggttgtggcgtttttcccggtggcggggtcagcgatgggtgtgttgagggtgcgcacgcgcgacagagcccagatacgggcagcgatctcaggatgccaggtgtcaggatcaggacggcgacgggcagtctcgtactggtaggcgatgacgtcaccatggttgttgcggatgacctcgaaaccttcgatgtcggagggaatgtcctcagcgtcgtagacaacagtcgtggtgacggggttggaggccgacatttgcccgatggtcacgcgcagcatgttcttcaaagcggaggtgagaagcgcggtagcagtggggctcttgtctgcccaacgactctcagccatcccgatcatgtcttggatggttttgacccatcctcgaatggggtcgaccttggtcagtttgatccctgccaggaactcgatgggccgactaatgggcccgtcaggcccgaactcggtatcccacccttcgtcgatcgcaagcttcaactcggcggcatcgacccacgtctcgtacgtggcaccaggcacattgggccaaaaccatcccgctcgaccctgggtacgtttgaccggaaacaaaccgatgccatcccaccaggacggcacggtgaaacggacgtggtaacgggccggatgccaaggatcgtcagtaaacaggtcgcgggcttcggtggcgccgagcagagtcgctggtgcggcaccgatctctccggtcactgatccggcatacatgaatcggccgtcgatgtacacgaaattagggatagaaccggcgggagcagtaggccgccagccctcttcccggtcaccagagtcaccggtatcaacacacagctcgtaacggtgctgaggcgatgtgcgctggatgagtacacccaattcagggtccatcggctccatgccataagactcaggagtccgcagcttccaaaggttaatgccctcagccccagggcgatccatgagagcccaatcgcggtcaatcctggtagcgataatgtcagtcagctcccgccatgcccagcgagcctgaaccggagtgagaacctggccaggaaaccactcatcagccacaaggacatccacgttgcggtcggtctccttatgagtaaaccggcctcgcgcaggccgacccgccagcatgaacaagccccgcacgtgccaatccttgatgaactcgcgagtgtgggcaggagtatcaggcagtagccacgactgaggctgatcagggatatcaccacagacgatcagacgtcgagcgtgatggtgcagcgcagtcgtcaacaaatccgacagagtggcgcgcttagtgcgccgaccccccagcaccggcaaaatctcgttcccggccgcgtcaaccccccgagcagtgtcaatatccagccacaccgtcacaggatcaggaggccgatgaggggcaggccgacgccgctcctgaccatcactcacgacttcctcctctgagccagagaacggccagcatcaagggcattgacacgctcgcgccgctcctcacgcaactgatagacccgaccacgggacacccccgcaacctcagcaatcgtggcggccgataaatgcccaatggatgcagcatcgacaagaacctcacgccacgccaaatcaatcgctcccagctgagctagagcttcctcacggcggcgggtggcgtcggccaccacgcaggcccaccctgcagggtggatagtctccacgacgattcggccatgacggatgggtccccatgcatcagcgggtacctgccagccatgatcagccgcggactcggtgattttgagtcgtcgctcaggtgcgcgggtgcggacagtagcgtcggtggtccaggtttggactggcacccacgccccttctcgggcgcgttcgatgacgcacgtggcgccatcgtcggtaaccgtgatgaccagacggtagtccttcccgtctggagtggttcgatagctgggcatgtagccctccccccatatgtcaatctaactagacatattctctagcctatttgacacattgtcaaggacaatagacctttcgtgtgaatccaccccgtcaaatgcacactcacgcctcatggcccgccgtgacgccttaacgaacccgaaccgctcataaaaccgctccgcagcatccccagaggatttgagttccaaggtgaaaccttgctcgtcagcccattggcagacgtgggcgagaacctgtgatccgtagccctgatttcggggggcggcatgcacgcacatcagcatgtgaccatgacggcgggtcggcgggctgacataagccccaccacgccagtccggtgtgatctgccaacttcgccatgccgcagcgcgccagcggcgggcctcggtagccaccatgatcaccatgatgatggacagggctacgacgccgactatggtcagctcactccagccaggccagttcccggagatgatccagcctcccagcgcccagatgatcatggcttccacgcccgccgcaatcgggacgagtggggcagtacggatgcggcctgccatgatttcggtgatctcgctgcgatgccacgaccaagagaactcccacgaggcacgaattaggctcatgcgtgaacggcttcctcggcttcgctttgccatagcttctctagacggcgctcggctagctcgtcggggcacggcgacagcctgccgcactcggagcagaccccgaagtggcgcgagagagtgatgaccggctcatcgggggcatgcaccgattcaacgaccgggtgttgctcatcggtgagtcctgaggcgtgaccaatctcggctagacggaggtgaaccataccgtcgtagtagtcgacgccctcaacgtggaacgggtaggagccggccgaggtgtggcctgcaaccagatccccgacttccagctgactggcggtcatggaccgcaccggtggcagcggggtccgggtcgcgttgatcctcatggtcactccttgcttctgcgccttcatctatgaaggtgtcataaccggggtcgatgtgcggagccacagtcactttttcagcagatccatcatctgggacccaccccctcccaaatgtgttaaccgtgatttacactttaaggcatgatcgaacacacaccgacacccgccgcacctcgcgtggccatcatttcccctagcgggccaccacggttctcggccgagcctcccagcgccgcgctgcgacgccatggtcggacccgcatgaggtcccttcccctatcccctcacattcgcgcctgggtctccaccagcggtcgtaaacccaatcccatagccaccgccctgatctggatgcataccggagccctgctgccggtgtgggacaccgccgttttgactgggcctgccctcggcagacgtgtgcgccctctcagcagtgacgccgaactgacctctcggcggtggctcgaccaggttgccgaccatcccggctttctcgacacccttatcgaggccgcccacatcaccgagggatggcatcacgcaacacctccgcacattcaggccccttatcggacccttcatcagtgaacggaggtacaacgacatgaccagtgacattgaatggggccacagccctgatggccgcgccgaagccttgctgtaccgggcttgggccaagatgctcgtgcgcgagtccaggctgccctggcgtatcgtcgccgctctcgccggggtctcccccacctccatgcaccggcttctgttcggccgcaatggccgacccgtggcatggatcggctccgatgatgcccgcgccctgggggccaccaacatcgaagacctcacctcagcggccaccgaccggataccggcccgcgagtcccgcgaattgctggtagccctgcacacccttggctggaccaacgcgcacctgagccgctggctcaccagctccgacctcgccctggccgacactcccaaggctctctacgtcactcgactatccgcagcccgtatccaagccacctacgacatgatcgtcagccagcccgtccgccgcaccggccacgccagcacaccgcctgtctcgtccccgcaccccgctgccttatcccagcccggggtcgccgccaccaccgagatagtccagcccgccctgttcgagctggccgactacgcatgagaggttgcacacatggttgaatcgaaggacccgaccagccaccaggaggcccccttgcgtctatatcgcgctgctctcgccgacatcgacatccaggtcaccgtccgtatctggagcaccgccgatcgtggctgggtctgggcccccctcgacacctggacccctgacccgacgccgaccacaccagcccagttgtccgacgagcttcaccaccacggatgggtcaccgccgaggcccccaccaccctcaccgaggtggatgtcacccccgagaactggcaggacctcgtcgaccacgccctcgctgcccgcaaccaccaagccaaccagctgcgcgtcgccgagaacatcctcaccgacatcctcggcgacgccgccgacgccggcctgtctgtcaccgctctcgcccgcacgaccggactatcccgagtcgccgtctacaaacgcagcgccaaaaccatcgactccatgagacacgccacccaggccggcggaatcctcaccccctcctgtctcacccacgctgagagaacagcgctcggcctgcccgacgagtaacccccatctcggaagcgccacgggcaagaaggcaaagcggcagtgtcttcgaaccggtcacgaacacgcgaccctcgacagcacttaggccaagtttcctaactaagacggaccaatgggaagcatttttcccacagcaccgcacatcggccggggctagggacccttcaccagtgaaggcaccctagaaggaagacacaccatgactgctgtagccctaccggacatcgctgatctggaccgcgccgtcgacgacctcaccgatgctcttatcgctaccaccgatgccgctgagactagtactgacggcagttggtacatcgaaagcaccgtcgaggagttacgcgccgccttggctgaggttgcatcccgtggccgcgcagtaggggtcccagcatcattgctggccggcacatcgcgggcatggcaggccgggcaagtcgaactgatccaaatctcagggcagatcaccgacaacctcatcagctggctggccatccaccccgagaaggcagcatgaccgcaaacacaggaagaaacaacgcaggcgaagaaatcctcgtcttcctcgttgtcggcatcggagggatagccctactgaacaagatggtccccaagatcattggcaatctcggagcatggcttcgcgcccacggattgctcgacgctcccgggcagggcttgtttgatcttggttcgttgggatcagttagtgctgcccacctgatgatcgccgttggtgtgctgatcattgtgggcgcagtgggggcacggttcactggtcgcagggatcagtcgaggatgtaaacgatggggcaaaccgaggtattggtcacagaatcgttgtggcgcggccgcgggtgagatgggggcggcaagcagttgccagttaaggcctgtttagttgacttaagcacactatagtgggtggtatgaatctcaaggagtgggcaggagtgcgcgggatttcgtatcagaccgcgctgcggtggtatcaccgtgggcttatgcctgttcccgtgcatcgagtgggaaggctcgtgcttgttgattgtgacgagcatgggttgccgttcgagggatcgacctttgagccgacgaaaacgatcatttatgctcgggtgtcctcggcggatcagaaatccgatcttgataggcagatcgctcgagtcatgacatgggcgagcgcgaaggaattgtcggttgatggtgttgtcaccgaggttggttccggtctcgatgggcatcggaagaagttcgagaaattgttgaaggatggttctgtcaggacgattcttgtggaacatcgcgatcgattctgccgattcgggtcggaatatattgaagcggcgctctcggcacagaatcgtcgtctccttgtcgttgacgacaaggagatcgaagacgatcttgtgcaggatatgacagatgtgctcacgtccatgtgtgcgagattgtacggaaagagatcggcgaaacatcgcgcccgaaaggccgtggaaactgtcatgatcactgacggtgaagaatccgttaaggatgatcacgcatgatcactgagcccgcggccccgaaactgggcaggaatgatccagatgttgttgtccggtcctacaagtttgcgttgaaacccacgacgtcgcaggaacggaaattgcgtcagcatacgggtgcagcaaggtttgtctacaattatctcatttcccagtggcgcgacgacattcacactcgtatcgaagaaaaagaacgtggtgttcctgaggatggattgacgccgttcacgtttaagttgtctgcctatgatatgcgcaattactggaatcgcaccaagggtgagtgtgctccgtggtggccagaagtgtcgaaggagatcggcaatgatgcggcacgtcgtgcccatgattccattgagaactggcatgactccaggggcgggaagcgcaagggtagaagagtgggcttcccccggttccacaagcgcggatgccatgaatcgtgtacgttctcgaccgggacgatccgtgtcaatcctgatcgtcactcggtggcactgccccgaatcggaaccataaagactcgcgaaaatacgcgcgaattgcaacgtaaaatcgccaaaggtacggcaaggatcactcaggccacgatctctcgcgggttcaattattggcacgtctccttcaccgtgtatgaaaagaaacacattcccgaaacccacgcacattccggctctgttgccggggtggacatgggtgtgggagatcacgtcatcgttgcggcaaccccaaacggtgatgaaatcatgcgtaggggattgccgcaatcggtcaagaaggatgaagcgcgagtgcggcaccttcagcgcaaactgtcgcgtaagcatggcccggataagaggacgaaaaccacgccctcgaatcggtggattcgcgcgaacaaccaggttcgcaagtatcgcaataccatggcgaacgtacgtcgcgatcttgccgcgaaggctgctcatgggttggcgacgaattatgagaccgtcgtcatcgaggacttgaacgttcaagccatgatgacgcgcggaggcgcacacaaacgtggtctgaatcgtgcgatagcgcaggcctcgtttgctgatcttcgacggagaatcacctacaaaacgaggtggaatggcggtagaaccgtcattgccgatcggtggttcccatcatcgaaaacgtgttcggaatgtggagaagtgaaatccaagctctccttgtccgagcgtgaatacatctgccatcgttgtggtgttgtcgtggacagagacctcaatgctgcaacgaatctggcgaaattagcggcaccgaaatccggtgtcgattttcacggaaccgggagttcgccggggatgggacgtggaggctcggggaagaccagctcaccctcgggtgagctggcaccggccggtgaagcgtcaatggcccgaaaggacctgagcggccgcaaggccggcacgagataacctgaccatcagagtcagttctcatgcaacggtcagtgggcgatggctaggccgatgagggcgccgctgcacaggctgggtgcccaggggaggaatcgggtggtgtggtgtcggaaccgatcgattagggcatatagggcgatcagggtgaggccggctatgaccgtggcgtggatcgtgtcgatgccggttgctgcgaccggggctgcccacagtggtgtgatgcgcacgtcggagaagccgaagccgcctcgggagatgagccaggcgatcatccacgctgcgaagatgatggtggtagcgatgacagcacgtgttgccgcagtctggtccgagagggcggtaacggctacagccccgatccatccggcccatccggtccacgctagggctgccggtatccatgtggtgatggcgtcaatgacggcaacccatgccccgatggtggctagcagggcccacgtcggccacgtgggtgctggggcccacattgtggcggcgatcatggtgaccgcagccgcggcacagaccgcgatcaagcttcggagactgtaggtgtcgcggtaggcgattttgtcgggggtggcggtggccggttcgggcaggatgcgagtgagggagggccatcctgcggtcgcaatggtcacgacggcggcgatccacacgatctggtgcatgggtctcatcatggcccaatatcgatgggtgtgggtggccgacatggggtcagtcgtcgagaggtttgcgggcggttgtggcttcttgggtgccgaggatgagggtgccggagtcgtcgccggctgattcccagtcgacgatgacctggtcgccgtcaacgctggattcggcgatggtcacccattgcccgtccatgtcgatgagcatcccggcggccagctctgtggcggcaaccgggtggggtgggctgtagaggaggtcgatgtcgcgggcagggtcgtcgggttcttcggttacctcaggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgcctcggccgcgtttgccgaacgggatgcccacgccgacgtgttcggagccgaacatcatgcgggctccgtcagcggacaggggtccggtggcggcacgcccggagaagttgtctcggatttcgccacccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccatccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggctgggtgggccgttgaggagggccatacgcgcggtagcgatggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacagcagtgccgactttctgctggtcggcggcggtgcgagggaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtgacccgtcgttgccctcaccggtgcatccttgccctgacgggcctgcttcgcgatcatcgacataccgccccgcaacgccgaaacacggttgtgagcgtgggcgacggccgacataccagctgtcgtaattttcgactggccctgcggagctcctcccccggtacggatctgacgatatgacgccgaagcacgccgcgccgccgaggccattcgcgccatcttcgcagcccgggtcactcccaccgacgcgccaccggtgactaccgcagccgcagccgaaaccatccgccttcgacccaatccagtgagcttgcgaccaccgctgcgcaccatccggcgagcaccccgcccagcccactggccaatcgccgacgccccttcagagcgcttactacgcatccagtcgttgatcttggccctcagcccctcctcacccttgtgactacgccacagagacaccaagaatccgatgattcccacgatttccaacatgttgacgaccatgaccttgatgacaacgttgccatcagaggcgaagaccgacttgatgacgagcatgaccacgcccagcatcaccatcgacccaacaatgccgatcatcgagtacaagatcgaacacagatcccggataagcgggtctgtgcgaccaggaatagcccgcagcacgttgagcatcgacatgaacgccgaccacaccaacttgcacacgtagaaccagcacatgcccgcgaacaccagcaggattgctgccaaacccgtcaccgttgacgagtaaaagaagaaccccaccaaccaggaaccgtccgcaatatcgccggcgtaatccgataatccctcgtcacaatcaccgaggtcgtcgcgtgcatccgagatatcgtcgtaaggaccacctttgagcacctcgatgtacttgtcgtgacatttggaatcaataatgcggccgtagttgagttgctgatgaaccggcgccacgaacgagtccacaatgatcgcagacagcttcggagccttcgagtctcccgtcgaggtcatgtcatcaggaacctcaacctcaccagcggtcgccgtcccaggatcaaccgaactggtaatcatatgagacagcgccacaccgaactgctgggtgcgagccagcggagtagccaacgtcgtcgtatcacctgcaaaattcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatatcgttctgcaaccccaccagcggtccggtaatccacccgacccagctcatcgccacggtccagtccaacaaccggcacaacagggcaatgaccatcaggtacgtgttccaacacatgccaataatggaggcccacatactcttcagcggggccgtaacgccaccatcgtccatcgacatctggtactgaaacaagtgaataccgttggagtcagtcacattgaaaccgtcacccatccagcccagcccaggacccgacgccatggcaggcacactgctcagcgccaccaccagaaccagcgtggtgacgatgatacggaaccaccgctccccggttccgggacggcgtggatgacggctcacgctgcctcctggtcgtgctcgggcgggttggagctggcggcttcgcggtggggagcgtaggcaggtctcagtagtcgaatttcaccgacgttgccgtgctgatcggcgtacaggccacaaccgggacctccggggttgagggcaatcttgaccaggtcagcgaactcttcaggggacgttttagggtcaacgcccaggaactcgacacctttctgggcgaggttgatgttgtcgcacagcaacacgatgcgatgctgaatgaggttacggacggtctcgttggggtaatcggcctcggggtcgtgggagccagtaatgagccaggcgttggctcggcgggactcacgcacgtactcgtcgatggcgtgggaggcctccggcgaggacgacatatggtggaactcgtcaacgatgaaagcggcgtcgcgggcccggtcgctaaagcacaccaggcgagccagacgagcaatgagcgcgtagagagcccggccaaacaccttgtgcgggggcagctgacgaaacaaatgttctgacagcatctcctcggcgttaggaagagcgatgccacaagtgccaatgatgaggatgtcggcgctcaggtcggcgggaggaaggtccgggtcaaagatggccgacgctagggaggccgagttctcgatgtcagcgaacacggcaatcctgtcagcgatcgcggtggcctcgggaaggtcgcattcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccggaggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcgaccaccgggatagatgcggcgaacgcggaggcgtgagtcagctgacggtaggcgcgaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctggtcgacggtttggcggatggcccgctgatttttctgcatcgcagcgtgacgggtccgggccactccccggatcgccacgtcgaccggcacgccagtgtcgtcgatacggcccaggaactcgtaggcaggccacgtcatcgtgcggggcaccttgcccagcgcaatgtgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgcggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaagtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcaggtttcgggtctgggaggggtttgggctcgtaggtggtgtcgatgtcttcggcgaggacgtggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacgcgccaccagcccgccagccatgccagaggtgaccaggtccagtcgatgcggccgatgatgaactgggcgagccatccggcggccagcgcgaagatgaaaccgcggatggtcatgcccccgtcgataattttgaagcccatcatcgcggcaggaactacgccgccgacagcgagcacctgatagatcgtgtaaggcccgccggggatctttcgacccgaagagtccttgccgatgatgcggggctgctggcgggcttcggtgtgccactggatgtccatgacttgcttccgggttctcggctctaccgggcgggagcctcaatagcggcctttgtgtgctggggaatgtccatgtcagcccttgcccagtccctgcatcatctgtccgaagaattggatggcgttgccttggatgagccagtacgccatgccacagacgaacagcatggagacgattttcgcgaggctcatgccgtgtcggaagatgttgaacgcggcgagggccatgactgcgagcatggcgacggctcgcactgcggagtttccttcacctgccttagttgtggtccattcgaagaggttctgcgattccagtggcagcaggaggaattgatcgagcatgagaggttttcctttcaggaagccgaccgggatggtcccggtactgacgggctgggcgacacgggtgtgccgtccggaggcagaaggcgtgacggctggtcgagggaggcaacctcccagcggcctgcacgactgacaagagtcaggccgtactggctagtccgggtagtggattcgtcaccggttagctggcatgtcacggtcgcggtgacagcgatcttctgccgatctgagggggtggggatctcgtcaggccccaccacatgagtggttttcaccgatacacacggggctgggtcaatcgccgtgaaagcggtccccgggctactccatctcgacaggtcgtcgctgccactcagcatcgcggccaagaaacccgaagaggtctgggcagccgggtcagcaggacgaatctccgaggagtccacgtcgggggctgaggccggtgcaggcatggggatctgcccaggcaagcgaagagcgatagctttgccgccggcatcgacgtggaccggaaccgaccaggcctgtccgctcccggattggccgcccatggtgatcactgtgacctgccacaggctcggatcagacggggagacggtagcgtcataggcggtgacggtggtgggcgctggaccaggtttgcggggcaaccgagcatcggtgatcttggacgccactaagtggcccagattgtctaggctctcagagtcagatgtcagcagcagagtcgtcacttcgactgcggtagctgaagctatctgagctgtgcggcgatcgtgatgggtggtatcagcgctgacagctgtagcgggggcatgcgaagggaccgccgaacggatcagagcgacaggaccacacgcgaccccgcacagcactaaagcgaggaagcccttagtggacactgatccggcgtggggccaggggctagcttcttcttgtgtctgcttcttcttggccaaccagcgacggcgaggcctggggttagcggattcgccttctgagttgtgtgctcgtcccagtcgcataggtcacctccttcattcactgcatgaagggatggggcgggtggccgatgtgcggtcaagtgcgaaaaaagttcaaattttttcgcgggctgtcacaaccacgattacagcggggttggtagcaggtttcacgacaccgcaggtatgtgagcctcacaaggggaacccctgagatacagaaacccagcaagttaagcgagtcgggcccaggcgggacggtcgagtgttgacgagaggtaggcgactcaggctggtggcttgccacgccgccagctccgtctggatgctgccacgaatgcgcgcctcgatgtcatggcggctgagactggacgcagtgcttccgacattatgcgcaccgccctcgtcaattatctcgacgttgccagctgagttcgggcatcccagacagtgggggcagaccaacggatcgcccccacgtacgcgtggcgagccgttatcgtcgccacactcggacggtgtcggtggtctttaggggtgccccttcgggtcccttgaggtagctgttgatccatcggggccggtgggagtgatcactggggtggtattgctggcgccagtggccgcgcacgaggaatcgcgtgtgaaggcggcgtcctgtcccgtcgcggtcggtggcgggttgggtgcgcagaggtcgcagatcgacgattgtcactggtgaggtcgactcaccggtacgggtggcccgctgcacgtcgcggcgcgactggtcgcggcggcggcgttcggcgacttgcggctgggccatgagggtccaggtggcccccacgagcgccatgaccgcgccgacctcggggcacgcgggggcgtaagcaccggaagtaccgtctccgtcgaggggcacactcacgacgtttccgacacgcaccgacgtggcctggtcgtcgaggacgaggatgacttggagctgggcgccgatgacgccccacaagacaccgcgcagtggctggcgaactgtcaagggtgctgccgcactcgcctggtaggccgtcaggcaagtgactggcggcagtggtccggcccacatgagtaggccggtcgggcacggtagggctgccgcgacggtccaggcgggcatatcagtcgacgcgtcaagggccagcgcggtcatgtcacggctgacccagtacaagtcagcttggcggactcgcgtagaccattgcggcgtaccgggcggggctggatgacctcgccgtgtcatgtcagcatcgagggcctccacctcggcggccatggccgccctgcacgctggcatatccttgccctgttcgattcttctcgtcatggttctgtcttctgcccggggctgcttcgatacccctatcatggacacatgataaccgcaatgccaacaattacggggtttcttgacttttttgcacccgattggagaggatcggcggactggaaaatcgctgtcgaatggcgcgctttcggggccgcgaatgaatagttcaatccattgcagccgccgcaattttcgaccctgtccgtaggactcatggatccaatgtccccgcacgatgtgcggggtcatcaggtggcgacccaagggcgaaagcaatagcgattatgcggacagtttggcaccgcgtagatcagcgccggtcaggttagcgttggacagatcaacgtcgtgcaggctaacgccgcgtagatctacgcggcgttaggcaggtcagcacgccacaggctagcgtcgcgtaggttggtaccgtacagtatgacactgcatagatcgacatcgtgtaggtcaacgctggacaaattgatactgaataggctaacgccgcatagatcggctcgcgtgttatttttatgcgccgccgcgacaattgcgagcacttcttcgcgattcataattcctccatatggtctaatttttgttggcgtcatttcgcctttgtcgtcacggtagtggtgacacctgggcggaacctccatgtcgacatgttcatagtagatatgctgtggcgtctattttatggtggattccttatttctgggcgaggtagttgtagatggtttgtcgggtggtggatagggcgcgggcggtgtcggtgatggtgtggcctgcactggtgaggtggcgggcgaggacctggtaggcggctctgcgagcggtttcgtgggtgtcggggattcctgtggtgaggggtcctagccagtcggcggcggcagtggcggcgcgtggaccccagacgtgccaccaggcgtcgacggcgggctcgacccacagtccgcggcgtaggaaggcatcggtgttgagggcttcgacgaggtgggcggcgccggcgaggtaattgcgggcagggttatggatggcgtgggcgatagctacggcgaggcgggcgaggtcgtcgtcttcgacgactgcgcgcaggattgcgagggaggcgtggacgtctccggtgcggatgtctgtgtcggtgatcgcggtgagggcgtggacatagagggggggttcggggttatcagcccaggcggcttggatcgcgccgatggcggcgcgtacgaggtgatggcgggctgcgtcgaggtcggtggactccatgaccacatcggtgaggatcgtggatagcgtgctggtcttgtcggtgaggatggctgcctctggccgatcggacgtgagtgcggtctggaaacgctgaggatcgaagaattcgaccatcgttagcatcgtggcgcggttgacccaggcggctagtggagggcctgagagtggatcagtggtggcggcatagtacgccagtcgctgctgggatgtcatggagtgtcctttcagtgtcataccgttcgggggcattgctcgcttctattatagacatatatttccccttagtgtcaacaatgacgatcccgtgtgggacgtcaggttttcagggtgctcgggtggcgggcatgtcagtgcgggacaccgctgctgcagtgaagttcttgtctgggccaccggtgaggcgcgagtcctttagcattactggcggctagttgctgcgcccatggatgggcgcactatcaggccgtggtcacatccactattgggcccgcgcgaatcaggtggtgattgctcacaggctggagtgaatgatggctcatccaggtgagacggtagctgcggtggtatgccacgcgtgcgacaacgctaggtgccagaatccgtcacatttggtggccggtaccgtgactcgcaatcggcgggagtacgtgagacgagcaggagctccaggaacaccgttaaatgacgtgcatggcccgcggggtgggcgaaattgtccaagacatcgttggcgtggaagtcgtgacggtgaacggtgccgggctagtgctcatgactgccgttcttgctaaatacgtcccgtacagaaacttttatcacgtggccggagctgtagttgtgtacgcgtgtcttgccgctgcggcggcagtgccgttttggtacatcgtcggcgtaagcggtacccaactgctcatccggcaactgatcatgtaggacgcagcgcacggcgtgccgaattaccgacgttggtcggcgcggtgtttatcggaaggctagcttcatccgcgacgcgagacatctcacgtagctcgcggcgacaatggtgacctaatcactgtggagccggtatcgctcgatgatctgcgtggaaactggacggccgaccgcgggtatctcgtcggcgatggggtggcgccgacaatcgccagtctgcagctgatctgaggtcataatcctttatctatgtcgtagcgcctgggaggcactccccagggtcgtcgtgtgtgcggaggtagggccgaaggctttggcgagataggcgacggccccccaacgctgctcgatagtgacgactcgacgactggtcgatcaactagtgtgggccggtctcccggcccacactgtgatgatcaatcggtcagactcgacgcgtcgccgcgtataggtctgtccccgaaatatcgtcgaggatccggtcaccgaagtatcgcagcgtaatttctgatgctacgtcggacagtaaccccatcgtgacttttacgacattccgacgccgtgctgacgccgacagtccccctaggctgaattgcgtcgtcccaagccactgccagtcgtcaatccacagaccgtcgccacgggtgtcggtgtggaactcggcatgggctgggacgactgtgccatcgccgagctggtagtacgagtcgacagtccacgctaggcgacccgcctcatcgcggtggatccggccgatggtgatccgatccaggtcatcagtgctaatctcggtcatgtcagaggtcctttctctgtcacgccctcggggagttgccgctcctgcgggggcttcctttgttttgatacctctattatagacacacagattcgatgatgtcaacaaatatcggggaaattcttggcttttttctgcgactttcgctgcggccggtcactgtgtcacctcgtcgatcgcggcgagggtagcttgcgtgagcgccccccagtttgctcggtacgtggtgcacgccggtcgtgccgagaagatcatatccagccccacgcggatcgtcgcacatgtcatcccagtcgtagttgctgtcgtattcgctgatatgggtccatgtcgtgacagtgaagccggtcctcatgacccgcacccacctcctgccggcaccgctccacggcacagccaccccactgactgtagtcgaggcggcatcaatccccaccaacatcgacttcgagaccatagaggcccggaaggtgcagcccggcggaggcatggcccacctgtcagcagaccgagcccgcccgatcctccaggttgcctcctggctgagcgcggcctggatactcatggccacccccaccgtggccgagcccagctcgacatgcgactcatgcgccaggttcacgccgtcactgacccgaccggccgacggctgacgaccgcgcacaatatgcctggtcgttttaggttgattacagctcccccgagctcaggtgacagggcgtttggctaaggcgttcacggcatcgctgatgatttgtttgagggtggtcccgggatgggtggctttctgatgggttagccattggtcaatgtcggcgggcagctggaaagagcgtggctgaccgggggtgcgcacggtgtgggttccgaagccgttaagggcggccgggggttgttccatatcggcggccacggctagagcatggccgatgatcgcagcgatgctatgcgaggggtggtcggcctgccatccggccaggagggattcagcgtcgtcggtgagagtgacaccgcgctggcgacggtcggttcctagatctagggcgggcagggtttctatgacggggttgtcgagccaggcacgtagcgcggcgtggacagtggcggtcatggtgccggagaccctttccagggcggtgtcgatcttgggatccaagcgcacctgaacggatccggggccctcggggagtttcccggccggtcctccgcggcgaggttggacggtgtcagccccggccacgcccagatgacggcgtagcgcagcccgcacgatggttgccttggggacgccgagttcctgggcggccgacgctagagagcgatggaggtcggcgggcaggtggaagaccctgggggtcgggtgggtgcgtttgttgctggggctctttgtcggctcggcggtgatcgggtgagcggtgacgtagtcgtcaatgaggcatacggccaggcggtaggggcgaattccggtggtctcggccatctcatcgagggcgtcacgcatatccggggtgacggtgagcatgactgagactcctccagtgcgggatgctctggcagctcggccacgggttgaggaggggatggtgtcggggatgcccagggcctgcgatagcgcggtgcggcacacggcggcgcgggagactccgcgataggtgacgagggcgtcgagggccagggcgagggtgtcggggatgcgcaatgccagtcccgggttggtggcgtgggggcctttgggtgccatcggttcggtattggcggggtgggcagccaggtagtcggcgaggatgtgagcggccacttcagagcgactggtgtgggcggtggcagcgcggtcagccagagcggcacgtatctcgggagtgatagatagccctagctggaacgtggccccggtgtgcggggccggcgtggctccacgtcggtaacccgcgctgatcgtgtcgggtagatggaaggtttcagccagggcggttcgagcaaccgccgccagggccacattgcgcctatctgctagcgcgtcgagggtggggcctagctcgggcagatggaggggttgcggacggtcatgatggggtttcctttggtacgattgaaactgagcgcgatgcttatcgtgttcgatctgatgtgtgggtcctcgccgagtagcgagggcccacactgtgttgttgtcggtttataggtcaaggtggggtattccacacaatccgagagtcgtggttggcggcagcgttgtcgaccacgtcgaggatgtctgcagcagacgtcgtgatggtcagctgccggtctctgatggttttgtgagcagtggcttaggtggagttgccagcgtcgactagacacacgtcgatgtcaggagatagtgacgtggccaccacgttcagcttatgttaagcctagacattaacaccacggtggacaagtcctgccgtttccccttggggggctcatgctgatctggttgtccgctgtcttctcactagatgtgtgctggtttttctgctcaccggtacacactgctcattgctagacgtcgtgtctatgacatggctgggcgtctagcagacgagttgacatcacccttaggctggcagcgttcgaggccgcaggccagagaaagcggacagcctaacgattgacgtccccctctattcttctctcccgcctcccctccccccgtcccctgaaagccgctcttcatctagcgttcccccgccgccgacaccttcctcttttactcaggttgagtcgaccatccatagatagatacatatgcatcggtgtatcgatctatcgatgtatctgggtctggttttaggaggagacgctcccagctacccctagagccaggcccctgctttaagcgtgctgccaggtaatgcccccggtttggcgagcggtcacccacacaagggctgggctggttgctactcccgccagggatagcggacatcctctatacacgtctgtcagtccatctttttcgtcgtatttccccttgtcagagcgttcttctcaaagtgacaacgctagtggccttgacgacaacgtcctcgacaacctcatggcggtggtctgtgtcttgtcagatcaaccacaccgggaaagagacaccgccgatgttcaccaccacagccaccctcaacgatgaatgggaccagatccgcaccattgagatcgattggcacgactgcgctgagctgatgcactgcatcgacgttgaggatgtgctggccgtcattcctgccgcccccgacgccatcttgggctacctcattgcccgggctcagggcggtgatgagttggctactcgcaccgtcatccaagcgtttgtcggcaagctcattctaatggccactgccacgaagctgcgtcgcactaataacggtttcgatgatctgttggcgggtctgtgggagacgatcatcacctatccgttggatcgacgtcctgacaagatcgccgcgaacctcgtcctcgatacgttgcaccgagttgtgaagttctggcgtgccgattcccccgatgaggaagacgctcacggattggtgcccttccccgatactcttatcgcccccgagcccgatgaggacgtcaccgcatcccaggctattgccctggctgctgaccgtcattggatcaccgaggacctggcccgcctcatgaggcacatctactgcgacggcatgaccggagttgatgcagcccgtctgcatggttgcgctccggccacggtgcgttctcggtgtcgtgacgggcgggctgcgctacaacgcaatgccgaggagatcctggctgtctgctgatctttccctcggctcgcagccgcctccaccgatggtgcaagctagagatctagcatctcatatagttgtctagctagctagattgatagcaatttttctagctacatctctagcacatggtatagcggaattacggctggatcgctagctcaatggcatgcttgccgatggaaggtgtgtcgacctcccaaaaagctggaaggagctttaccgtgcagggcatgaccagtcccattgaccgatccccgttcgaccgcaccatcgcggtatggaaccacaagggcggcactttcaagacgtccgtcgtggcgaacctgggatacctgttcgccgccggcggtaacaaggtgctgatggtcgacatggacccccaagccaacctcgacatcgacctcggtatccctgctggggaacgcgaacgaggcgtaggactagccgaggcgctgcgtgaggggaatacccttcccccaccgcagcatctcagcgagaaccttcacctgatcagtggtggcccagccctcaacgaattcaccgaccccgcctccctcgcagccatccttgagcgggtcacaaccgcacgttacgaccttctggcccaggcgctcgcaccactagcctgggactacgacctgatcttcatcgactccgggcctgctcagactctgctatcccagaccatccttggagtagcccgctacctagtcgtgcccacccgcaccgataacgcctcgatcatcggccttgttgacgtccaggacgccatcgacggggtcgccacctgcaaccccgatctgcaactactcggcgtcgtactagccggggtaggcgcccgcgccactcggatcgccgccgataaacgccacgccattgacacggtcctgggaacaggaaccgtcttcaatgcggtcatccactactccgaaaaagtggccgtactcgcacgccaacaaggcaaaaccgtcgccgagctagccgccgaataccaccacacccagcccgcctacacctacctagcccagggcaaaaaggtccccaacgtcgccaaagcggccgtcagcatcgaaaccgactacctgcggctggccaccgagatcagtgaccgcatgtgcaccgacgacgagcaggaacccactcatgactgacgacccgacctcacccacccaaacctccaccagcgacgacatgcgcctagccgaggaatgggccaatagcggccgcacggtgggggcccttccgcaccgtcaacggcctaaaggctctattccccgcaccgccgaacagccccctgtctcgtcccctgccacccacacaccagccccgaagaaaccccagacggccacaaccacccagcccggacgccagcggatcaacgtcaccgtctacgtcgtccccgcactccacgagcaactgcgctcccggtcggcggcgacgggggtgacggtttcggatctggtggtgcaggctttagcgttcgtcgccgatcacgcagccaaggctgtcgccgatgacctgcgtgtcgagacggtccctggtgatgaggctggattgttcgatgtgaccccgtcgcggccggtgggggtcgccaaaacccagttgggggtgcggatgacccgccataacaaggctggtttggaccagctgacccagatcagcggggcccgtgaccgcagccatctcgtgtccgtcgccgtgcgcgactatctcgactccaaccctgtaaagaaaggccgacatgtccgctgagactcctgctgcttccaccgagcggcgttttgatacgaccgtcaagcccaggcggcgacccttattcgtcgcggccggtatcgccattgtggtggtcggcgcgttgctcatcacccagttaatccacgcgagccagaccgagaatcgcgtgctggaggttcatgccgatgtggctcgtggcgaggtgatacgtgacaccgatctggtggcggtaaccgtcggccaggtcgacaacgtgtcgacagttcccgctgatcagctcgactcactggtcggcaaacgcgccacggcagatcttcgagccggatcactcttgcctgccggggccattggtccagccgatgtcgttccagctccgggcaagtcgctggtcgggctgaagctagccgccggacagatccctatcggagaccttgctgccgggacgaagctgcgcctgatccagacctcggcaggcgggtcatccaccaccgggcagggcgccaccaataccgatattcaatcgtgggctgcgacgatggcgtccggcaccaaaagtactgagcaggtcaccttgatcaatgtggaggtggactcgcgtgatgcagctcggatcgcccagctgacatcgcagggccgtatcgctgtggtaaaggattcgactcgatgagcacaatcgttttgaccagtgtgtcgggagccccgggggtgaccacgacagcgattgggttggggcgggtctggccacagtccagtctggttgtcgaggacgacacccatcacgcgatgttggcgggctatctgcgagctgcccagcacgccgagccgaacttggccacggtggcaaatctgacggccactccgaccaatgcccaaaccgtgtgggaatccatcgccaggcctctgcccaccgatgatccggtcagcgggctgagacgcaaggccgtcctcggcccgcccacaccgtggtctcgtgcaggtatcgacccccggtggggattcatgctggccctgtggcggcagctggccgaggccgggatcgacaccatcatcgacctgggtcgcctagccacgccgctgacgtcaacgccacatctgatcgccacacccatcatcgacgacgccgacatgatcctggtgatgatcgaggcgacgctacgcgatgtggccggcgcccacacgatgatcgaagggctggccgagcagatgaacctggccggggcccaccagcgcctcggactgttggtccaccgcggcggcgcggcccgcggggtcgctgagttcaccgacaaagagatcacgtcggcgttgcagctaccggtctgcgggtcgatagtccatgacccagtcgcggcagcccagctgtctgacggggtcgggcagcggttcgacaagtcgcgtctagcacggtcgttgtcgaaggtggcgggcgttctcgttgatgtcattggtaggcgtcgtgctgatagcaaggaggatctgtgatgaccggtttttcggacaatccgttcgacaagttgcgctcgcgtcctgatgctgaggtgtggtcggcgtcaggggccgtgcaggtaggcatgggggaggctccggcgggggaggggcccgggtttgtttcggagttattttcggcgtcggcggggtgggccagttctcagcaggtgactcaggctcccccggtgatgacccgctcggagaaggttgattggccgattgttgcggagctggccagtacggccacagacgagattgaggccgagatcacccggtggagttccacccatgatggggtagcgacgctggacattcgtcaagccatcgcagagcctgctatcgcctcggctgtggccacgtatgctgaccggcgtcagatcgatgtgggagagacctggcctgatctggtacgtcagcgctaccgcaaggctgtgtgggatcagctgttcggaatggggcggctacagccgctgttcgaaatcggcgacgccgagaacatcattgtggtgggcaaccatgaggtggttgtcgatcacaacgatggttcccggtcgacgttaccgccggtggcggactcggacagcgagttggaatcccaaattgcccgaatggcgaggaatgcgaccccgcggcgggccttcgacgccgatcacaccgatgtgacgatcatgcatgagcagaagttccgtattcacgcgatctcttcggaggtgtcgttgcagccatcggtggtgatccgccagcacttgctgacccagatcagtttgggggacctatcacagcgcgggatgatgccagtggaggtggcccggttcctggatcaggcggtgcaagctggcaagtccattgtggtcgccggtgagcagggtgcgggcaaaacgacgtttctgcgcgcgttgatccacgccattccgatgcgcgagcggttcgccaccttggagaccgatcaggagctgttcgctcacttgatgccgggccgacaagacacgctggtgttgttcgcccgtgacggtaacggcgaggtggatccggcgactggcacccagcacggtgctatcgagatcgcccagctcattccccctagtctgcgccaggcgttgacccgggtcatcgttggtgaggtgcgcggaaatgaggcctcggcgatgtttcaggctatgcagtcggggactggcactatgagcagtatccactccccgcgagcctctgaggtgccgtcccggctagcccagatgatttcgatgggtccggtctatgacctggatcaggccatgctccaaattggtcattccatcgactacatcgtcttcgtgcgcaagcgtgacctgtctgacgggacccggctgcggttcgtcgagcagatccgttcggtttcacctggcgattcgacgactcccagtcttggcgaggtgtatacggccgattcgtggacaggtcagccgttaaccccgcttatgcctggttcagcggccgatgagttgtctcatttcgcccgcgacttggattattgcgaggcccactcatgaacgcacctgcactgaccagcgccctcatcgtgaccgggttggggctgatcttggttatcgacggtctagtgccctcaacgcctcgtcctggagccgcgctaagcccggcccagaggtgggccaggctcacccaccgtcccgctggtgcggccgggcgtcgccgggatttgcgttgggggttggctgttcttgtcggtgtcgtgttgtttgtgctcaccgggtgggtggctgcgctggcgttgggccccattattgcgctgctggcccccaccttgctgggggcggccccaccgaccgatattccgctcatggaggcgctggatcggtgggtgaggcaggtggctgcggtgctaccccaggggcgcgacatcatcacagcggtgcggatctcgaggccgcgggctccgaaaatgattgccgagtcggtggaccagttggtgtctcggctggacggacggatggagccgcgcgaggcatttcagaggatggccgacaagctggactcggctgaggctgacgcggtgctggcctctctggcgttggcggccactcatccgcggggtgcctcgacgacattgaaggctattgctggcaacattcagcagcggttaaaagtgctgcggcaggtggaggctgagcggtctaagccgcgcaattcggtgcgtcagatcacgctggttacgatcgccatgttcggggcgctgctggttattgggcgggcgttcctggccccattggcaacccctcctggtcagatcctggtagccgtggcggtggtcatgtatgtcaccgcattagtgcagatgtatcggatggcgcgcccgcggcaccgcacgcggatcatggttaggaggagtcgatgacgacgactgcgttgtccctgctggccggggctattgtcaccgtcgggttgttggtcatcgtggcagcgttccggcctgccccaggccctgatctagtagccgccttggacgtggtatcgggtcgcacctcggcccttgacgagcaggtctaccagacccgggtcgggcgtttaggtcgcagcgtgacccgcacgttccatgtgtcggtgtcgccggcgatgcgagccgcgctgcggttgcagggcgctacccccgaggcgttctacgggcgtcgtttgatttgggcgttatgtggggcgatcctgccatggctactcaacgcggtggctatcgcggtgggggtgaatttcccgggcttgctcatccctgcggcgctgtgtgtggcgctggctggagctgggtggatgctgccggcggcacggttgagggctgcggccggacccaccaacgatgactcgttcgaggcgctgctggtgtttatcgacttggtcgtgttggaaaggctcgccaacgagacctccgtcgacgcgctcaccaacgcggcgaacatgtcagatgccccactgttcgtccagatccgtcaggtcctcaaccgtgccgccctggaaaacgtcgacccgtggaacggactcgaccggctcgctgacgacattaagctgcccgaactcaccgatgtggtctccatcgcccgcctccaggaggaaggcgcttccttagtcgatagtttccgggcccgggtcgccgagttgcgcgacgcctacttgctgcgcttgcagcaagagtccaccacgatcacccagcgccttggcctgtggacgatcctgcaagccggatcggtcatgctcatcttgatgggggcggccgcgctcacactgattacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtcttgtcgtggcaacggtggttgctgtgggcgccgtggtgatggcattcatcaagtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccagctccggggtcggcacaggaggcagcctcgcagatcactagtcatggcggggtgcgtgatgcgcgggtgtcggtgcgtgatgatggttccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgagtggcgcggcgggggctgcggcccgtgcggcgtcgttggagcgtgatggacagtcggctcagtctgcggcacagcaggcggcgtcggcaaacctgtcgtccggtgggctggcatgtgcgccgagtgtgagcgtggacacgtcagtgtttgcccgtcctgccgggcaggcgggcacggttcacgccacggtcacatgtgtcacctcgctgggtcttgggttcgggtcccggacggtgcacgcaacggggtctgccccggtagacacctatcgggaaaggagaggctgagatggcccgcgatgagcgtggtggcggctcggtgtcggtgtggatgctgctcatggtgccagtgattctggtcatggccggcctggtttttgacgggtcccgtcagatatcggcaacccaggcggcccaggacgcggcggttgcggcatcccgcgccggaactgatgcggcagcgacaccgcagctagctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgcttgtggtgatagccggcttaccggccgggctcgtggccgcaggcgccccgctagtaccctcgggcctgtcatgggcccatgtgcggcatctgttggttaccccagacatgaccgggtctgtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtgacggcgcccaattccgtcgtatcgccgaagcctccggtatcgacccgcactcagagctgaaagtcggccagaaactggtgctaccggttcccgagaacacggccgcagttcattcggttaaagcgggggagtatctgtgggagatcgccgagcactactacggtgacggtgcccagtaccataaaatcgctgaagcttccggtatcgatgcccattccgatctagccgtgggccaaaaactcgtcatccccgggcccctccgccacgacgccacgccgccacaccactcggcgtcgacccacgcgaaggccgccaccccagcccacacgcccacgcgacggcctgcgcctgcccacaaagccacgcccgccccgacgccggccaccccaactactccgacccacacggtgaccccagctccggcctctgccggccactcgaccagcgacgagcacccaatccatacggataccgccgcagcggacaaggccagcgacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgacgacgaccggatcgacctgctgttatcgcaggtgacccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgccggaaccttgcacctgatcgccgacgacgaccaggtcgacgcggccctcgccgcgatcgccgtggaactggccacctgtgactggtccgacgaagtcaacgtcaccctcgtcggccaggtgtgcccgggcctagaagaggccttgggctctccaaccttgactcgcgccgccaccgtcgacgctctcttggagacgttggaggctcgcgccgacgatcagcgtcacgttctcgccgaaggaggctccctggccactcgccgagccgacccggctatctccgacgggtttgacgctgaggtgatccttcttgacaccgacctgaccgagtcccagcgttaccggctcaccgacctgatcaaggacctgccccgggtgtcggtggccgcggtgacgaccagctccaccaatccggatgactgggccctgagcttctcaggtgacccgctggtcgcagagttggtccccctcggctggcacatcaccccccagaccctctccccagatctctacggccgcgtggtcgaactgctagacaactctgcggccgacgactacgcacccgccgactggtgggaccatgacgccgaagaaactgacgaggatgagcctgtcactaccagtaggcgagcccgccctagtatccgcttgaccaccctgaccggtggtatcgatttatccagcgtcgacattgacgccatcattgatgacgccaacgaggctctcgatgctgaagagactaacggcggggtttgtgttgatgctgcccagcctggcactaataccccgttccctatcgatgaggttgacccgttaagtggtgacggtccggtcctgtcgatcattggtcatcccgacatcatcggtgccgctgggacgaagggccgctctccatggcgctgccagcagttggccctttacatcgctgagcatccgggagcatcaggagccactatcgccgacgacctaggtctctcacccgcaactattcgttctatgaccacgcacctgcgccgctggttgggtgctgacgggaacggggtggcctacatgccccccgccacgcacggctaccggcttgatgagcgggtcgtcactgatgtggatttgattgatgctgctttggctgggcgaggcatcaataccgccgacaccaccactcttgtcgctatcctcaaactcagccgaggccgaatattcgccggaattcccgactcagacctccgacagttccgagcatccacgtaccacattgaagcccggatcgttgatgcggctcttcaggtgacggatcgggctttggaggccggggacttggatctagcccggtgggcactcacccaagggctactagcatctcccgatcatgaggacctggtagctggatgtgtgcgcaccgagtaccaggccgggaacatggacaaggtcgctgagctggttgatcatctatcggctaccgcgcgacgcctgggtgtcgatttgaacgaggacactacccggattatcgatacagtcactcacttgggcaggaaagcctcatgaatgctcctgcgcctcatttgttttgctagaaaggttttcatgcatcatcatcgcatcatcgtggctgcggtagcagtcgctgctcttacggtcggctgccactcgacaggctcaacatcggcccctacaccggcaccaagtgcctccacggtctcggcgagtcctgcccctagcccgacccccacggcgggggcgatcagcgcgaccgacgccgaaaacatctaccgcaccttgcacaccaacgtcttcgagttggagaagaagggtggcctggtacccggggaacccgcacccgcgaccctgtcgaactacgccaccggccaggccctcaagaactacatgaccttcatgcaccaaatctcgggtctaggtctcacatggaagtcgggagcctcaaagatcactgtggtgcgggagaaaaagggtgataccacctaccccgaggccgctatcgccttggaatcgtgcgaagacggcagctccatccgatcggtggaccgccacggacaggctgaccatggccggctcacacacgtcgacagttggtatgcccgcgataagaagggcaccatcaaaatgatcgcacgtaacggagtggaggtttcctcatgcgacgtcaagtaatcaccgcggccgtgctgggcctgaccctggccaccacctccctgcccgccctcgcagataatggagacttcagtggccatacagacacggatggtcctggttacgatgtgcgtactgaggtggattaccatcacaccaccggtggtgcgggtgggggtgccacgacagggggccatcatgggggcaaaacccacggtgatggtgaaggtgaggctattgatgggcgttctcgcgccgatgccgaagccgaactagacgaagccgaccgtaaccaggacttgacttgtgatgtcatgctcccaccggcgccgaataccccagccggccaggaatgggcgaaagaatgcaatcccccagcgaaaaaggggcagaaggccaccccgaagcccgacccggtgttagtgggccgtcacgcagccttgcagctcacccttcccggcgcggcccctcgtatcgatccgtcccccgaccttaaccggtggcactcggcagcagtgggccaggctttgtggttgtcagttgatgaccccaccgccactacacagaaatcgatcacgtttatgggccaggttgtctcgttgagcgccaaacgtaacggtttgtcgtttgatatgggtgatggtcatgtcgtgcactgtgatgccacgacgacatggacggagtcggtggaaccggggaccccctcacccacgtgcggttacacctaccaacaggcagccccggccgggggctataaggtcaccgcgatcacttcgtgggatgtgacctggtcggtactaggacacacgggcacagtgcatgttgagaaagccggtgggcagatgcttcccgtcggcgaggtggagtcggttgtcacccgccaatgacccctgataacccgagtctctacgaggtgttggggataccaccacaggcatccccaacacagatcaaagaggcatggcgcaccaccgcgaaagcgacccaccctgatgccggtggcaccaacgaggccttcacaaccgcccagcacgcctgggaagtgctgtctgatcccgaacagcgtgctgcctacgatgccgccctatcgggggaggacgcctctgaccaggaggcccttgacggcactgtggacgtcgaccccctcgccgagtggccttggtgtgtccccttcctcgaggccaccccacgactgcgccacccgtgccccggcatagttgagtctgtcgtcgtggccgccgccgggatcatgaccggcatcggctggcacgagctattgaaatcacttgtcgtggccccggggttcgtgggggcgtggtgggtgatttcggttccattggtcgtggcagtgacatggctcggcgcgatcacggggatttgcgccatcatggccgggctcgtctggctgggatggggtctgatcggtggtgcggccttgtggggtcagccgtgggtggtcactgcgatagcaaccgggtgggtggcctgggtggccggtgtggtgtggtggtggcaccgacggatggcctggcctgcccgcacctgccgggcaggaaacatgattgacatgcccgaggatgacccgccgtgggtagaaccggtggagttggtggcagaactcatcccctccgtgcgggctatgtggtcccctgataggcaaaccgttgtcgtgatagccggtcggcgggtagcgacgttagggatgccgatgcgagggtggcgtggcatcgatatgcggggctggaacccgatcggtgccgacaccgcgtggatcgttgaccagataggcggctggctggccgaccaagacaaaccgctcaccatcgacgggcgcatcttgtacgagacctgggacaggctacagacagttcgtcctcacagctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgaggactcgcgtcaggcagtagtccgggaagtgcacgaagagctcggcgtctcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggacccttcctgaccgatgtcgtgcgcaacaatggacccatgagttcgcctaccaagatgcgccggaagggaacacgcggcccgaaacctcgcagcgacgaggagctaacggctgtgatgtgccgcatcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcactgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagacctagaagatccaaaagaaccggtttcagcttttgcttcggtcttcatggtagctgatagcccgcgtcgttggaagtgcgacgacgccgatcctcatcggtatcgcaccctgaaacagggtgttgaacatgaagggttgaccgctatgtcaagccatgagacgccctcccggagggcgtcatgaccgctttaattcaagctctgccgacagctgaactgtctgctggacctggtgctagcagtccagctagaccctctgctgagggcttcatcaagattcatcacgacctcattagtgcgggcgtgtcggggaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgaccatcgtggcccggttcctgggctgttcttcgcgccaggtctcccatatccgtggggctctcgttgatgccggtctgctcggctgtgacgaggtgtcgggggcggcgagccgggtgtggttcccctcgatggccgaggagtgtgcagcggatcgtgaggtggtcgatggggccgtcgtcgatgctgaggtgggctctggtgaaggtgtcgaggagggcggggaacccctgtcgattttgtccacccacccctgtcgattttgtccacccacccctgtcgattttgtccgccaagtattagacaaaccattagacagtgaattagaccctgggtcgcgtcagcgtgttagctcaccaacgcgcgcgcgcgcggcggccgagccgccgaagccaacgaaccccacaccaccaacgcctgaaccagcagcccccgcttcagacagtcctgtgtcagcgcacgctgatgaggctgccgagttggcgtggcagttcgtggggtggtgtcctcagctggtaggggcaccaaagaaggtgcgtggccagctccgtcagatggttgccaagcagatccgtctccatcgtgcctggctggatgtgccggcgttgactgttgccgctgagcgagtccgggaaatcggggcgctgggtgatcggcactgcgagatcgttcgagaaacgttgcatggcgtgatcgccgaccgcaaggcagctcccccagccccctcaccctcaccagacgaaggagacacgactgtgtggatttacaaagaccctcatgagactcttgacgagtttgcggccaggactgagccctctcgtgtgtgggaggtctccgagcgcgatgacatggctggcgggatcgccgtgaacttgctggcggctaagccggatgatccgatgggctggctgactcgccggcaaaccatgctgatggtccggttcccccaagccgtcgacgaggtcgtagagatgtgtcacatcgtgcgcgccgccttggaggccgacatggccgccggaacccggtgggaggaccgatgaggtcactgcggcgaaacatcatggttgtggctggtgtgctcggcgtcgcggtagcggcgggcccgaccttagccaggtcgttgccgtttgctgccgacacgacaccgacgagcagaaccgctactgccccggctacggtcggtgcgggggccgctgctggggcgttgaaccgtctgccagtcaaaggcaaagcagcgatgaccggatacagccggactcaattcgggcaggcgtggaccgatgacaccgaccgggaactgacccgcccctggggccacaacggatgcgacacccgcaacgatgccctggcccgcgacctggtcgaggcccacctgaaacccggatcacgatgcgtggtcgcctctggtcgcctccacgacccctacaccggggccacactcgcctggcggcgcggccggcacacctcaacggcagtccaaatcgaccatgtagtcgccctcgggaacgcctgggtcaccggggcccaacacctcccagcaccgacgcggcgcgctcttgcgaacgacccactgaacctggtggccgtcgacgggcctgccaacgaagctaaacgcgacggggacgcagccacctggctaccgcctaacaaggcctaccggtgcgactacgtggcccgccagatcgcagtcaaaacgaaataccagctctgggtcacccccgcagaaaaaaccgctatggcgcgggtactagaccgctgcccagcccagacacttcccacaggagccacacgatgaccacccattggacccccgaacaactcctagaacccggaatcggagtcatcctcgacaccgaaaccaccgacctggacgggcgcatcatcgaaatatcgatcattgacgcagcaaccgggacagtcctgatgaaccaactcatcaacccccaaggagccccgatctacgccgaggcccgcaccgtccaccacatcagccccgacgatctcgcgacagcccccacgttcacccaggtgtggccccggctggaggatgtggtggccgatcgggtcgtcatggcctggaacgccccctttgatcagggacgtatcgaagccgagtatggcctcgcagggctggatgctccggcgtggccgtggtgctgcctgatgcgtttagaagcggccatgatgggctgccgatggcggcgactagacgggccacaccggggcctcggcgacgtgatagcagccaggcagaggcttatagcgttgcagcagatgccgtcgatgccagccaccgcctagaacaccagcactgacaggcgcccgagtggattggggttggatcaggcaggcagataggtgtcgagggcgtcgcggatgacctgggaggcgctggtgacggtctgggctgcgtaggcgtcgagtcgggcgttggtgcgtgcgtcgaggcggacctgacggcgaggtgaccgcccctggccggtagcgcggtctgagccgagtgccggccgtcctcggccgaggaatgcgcggctggcgcgcgcggcgtccttgccgtggaacaccgggctggtttgcggggtctgggttgcctcgtcactctcagcccactcggccagagcgtcgacatcgaacccggcaggggtggtgctcatgctcgctctccgttcagcttggtgatggtcgtggctcgcctgatcgtttcgccacggcggcaacagggagcggctgggtgtggggcggggccgggctgggccc

SEQ ID NO: 189 - DNA, 15010 bp, Propionibacterium acnes
ggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcgggccggtaatccacccgacccagctcatcgccacggtccagtccaacaaccggcacagcaacgcaatgaccatcaggtacgtgttccaacacatgccaataatggaggcccacatactcttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccgccgctccccggccccggggcggcgtggatgacggctcacgctgtctcccggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcgttggctcggcgggattcgcgcacgtactcgtcaatggcgtgggaggcttccggcgaggacgacatgtgatgaaactcgtcaacgatgaaagcggcgtcgcgggcccggtcgctgaagcacaccaggcgagccagacgggcaatgagcgcgtagagggctcggccaaacaccttgtgcgggggcagctgccgaaacaaatgttctgacagcatctcctcggcgttaggaagagcgatgccacaagtgccaatgatgaggatgtcggcgctcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcgaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcaacattgtcgagctggtcgacggtttggcggatggcccgctgatttttctgcatcgcagcgtgacgggtccgggccactccccggatcgccacgtcgaccggcacgccagtgtcgtcgatacggcccaggaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcataagtccggcggcttcggtgattttgttgagggcggcggtccaggcggtgtgggtgcgtattttctggtcttggttgagtttgatcgataggaaccacacgcgccggcctagggatgcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtaagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgacagccatgccagaggtgaccaggtccagtcgatgcgaccaacaacgaactgggcgaaccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttgccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggcggcaacctcccagcggcctgcacggctgacaagagtcaggccgtactggctagtccgggtagtggattcgtcaccggtgggctggcatgtcacggtcaccgtgacggtaatcttctgccggtctgaggggggggggacctcgtcaggtcccaccacatgagtggttttcactgatacgcatggggctgggtcaaccgcggtgaaagcggtccctgggctactccatctcgacaggtcgtcgctgccactcagcatcgcggccaagaaacccgaagaggtctgggcagccgggtcagcaggacgaatctccgaggagtccacgtcgggggctgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgcatgggcctcgtaggagtagctcttaggtaggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatcggtgcatcgatatacctatgtatctgtctgtggtttttagaggccactcccgtcgccccgggccgctcagcgataccgcaaggctgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgaatgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcgggtctgtgggagacgatcatcacgtacccgttagatcgtcgccctgacaagatcgctgcgaacctcatcctcgacacgttgcaccgggttacccggttttggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaattgatctagctatcatatagctgatgatctagctatcatatagctgtgtctccagcccaaaggacagcccaatggcatgcttgccacaggaaggtgcgtcagcctcccgaaatactggaaggagctttagcgtgcaggacatgaccagtcctattgaccgatccccgttcgaccgcactattgcggtgtggaaccacaaaggcggcacgttcaagacgtccgtcgtggcgaacctgggatacctgttcgccgccgggggcaacaaggtgttgatggtcgacatggatccccaggccaatctcgacattgacttcggtatacccgcgggagaacgtgaacggggcatgggattagccgaggcgctacgtgaggggactgtccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaacctcctgtctcgtcccctgacacaccggctccgaaaaaagcccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggggcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcagcggaagtgtcattgcaaccgtcggtggtcatccgccaacatttgctcacccaaatcagtctgggggacctgtcacatcgcggaatgatgccggtggaagtggcccggttcctcgatgaggcggtacaagctggcaagtccatcgtggtcgccggcgagcagggtgcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcctcggccatgttccaggccatgcagtcgggtacaggcaccatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgatgagctgtctcatttcgcccgagacctggattactgcgaggcccactcatgaacactcccgcactaaccagcgccctcatcgtgaccgggctagggctgatcctgaccatcgacgggctggtcccggcgccgcctcgacctggtgccccgctgagcccggcccaaaggtgggctcggctcacccaccgtcccactggtgcggccgggcgtcgccgggatttgcgttgggggttggctgttcttgtcggtgtcgtgttgtttgtgctcaccgggtgggtggctgcgctggcgctgggccccatcattgtgttgttggcccccaccctgctgggggcggccccaccgaccgatattccgctgatggaggcgctggatcggtgggtgcgtcaggtggctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctctctggcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctagccggggccatcgtcactgtcggactgctggtcatcgtggcagcattccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttacgcgacgcctacctgctgcgcctgcaacaagaatccaccacgatcacccagcggcttggtttgtggacgatcctgcaagccggctcggtcatgctcatcttgctgggggcggccgccctcacactcatcacagccggataaaccgacaccgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcgatggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccagctccggggtcggcacaggaggcagcctcgcagatcactagtcatggcggggtgcgtgatacccggatatcggtcagtgatgacggggccactgtcacggtgaccgtggtgggccgggccccatcgatgctggggctgcatcttccggctgtgtcgtcgacagcgtcgatgcccaaggagcgcctgtcgtgaggcgaagtgagcgcggcggagcaagtctaagcgtcgaggtgctcatgtgggcgccgatcgcgctggtgatcatcgggtttgttgtgggtatcggccggatgtcgatggcccaggacgcggtgagtggcgcggctggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttggattcgggtcccggacggtgcacgcaacggggtctgccccggtagacacctatcgggaaaggagaggctgagatggcccgcgatgagcgtggtggcggctcggtgtcggtgtggatgctgctcatggtgccagtaattctggtcatggccggcctggtttttgacgggtcccgtcagatatcggcaacccaggcggcccaggacgcggcggttgcggcatcccgcgccggaactgatgcggcagcgacaccgcagctagctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtgaccgggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtctcctcattgccgcgttcgcgggcgcaccggcggccacgtcggcagctcacgcggtcgaggccacccatgtggcggtcgcagctcaggcttccccggcccacgcggccggcacccaggacagccccgccaccacctctcaggccccggacgcctccaccactccgaaaatctggaagacctacacggtgcgggccaacgactacctgtggaagatcgccgagcactactacggtgacg

SEQ ID NO: 190 - DNA, 13200 bp, Propionibacterium acnes
aacaacaccgaaccgttccaacccgccctgttcgagctggccgactgcgcatgaggaccctgcacagacgtgattaaatcgaagggctcaaccagtcatcaggagtcccccgtgcgtttgtaccgcgctgttctcgccgacaccgacatccatatcaccatccgtatctggaacactaccgatcgtgactggacctgggccccccttgacacttgggcccccgacccggccccgaccacaccagcccagttagccgatgaacttcaccgtcacggatggatcacccctgaggtccctactaccctcaccgaggtggctgtcatccccgagaactggcaagctttcgtcgagcatgccctcgctgtccggaaccagcaggctgaccaattgcgcgtcgccgagaacatcctcaccgacatcctcggcgacgccgccgacgccggcctgtctgtcaccgctctcgcccgcacgaccggactatcccgagtcgccgtctacaaacgcagcgccaaaaccatcgactccatgagacacgccacccaggccggcggaatcctcaccccctcctgtctcacccacgctgagagaacagcgctcggcctgcccgacgagtaacccatcgtttacatcctcgactggtccctgcgaccagtgaaccgtgcccccactgcgcccacaatgatcagcacacccacggcgatcatcaggtgggcagcactaactgatcccaacgaaccaagatcaaacaagccctgcccgggagcgtcgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgccttgtcttcttgcccgtggcgcttccgagatggtcagtgggcgatggctaggccgatgagggcgccgctgcacaggctgggcgcccagggaaggaatcgggtggtgtggtgtcggaaccggtcgattagggcatatagggcgatcagggtgaggccggctatgacagtgacctggatcgtgtcgatgccggttgctgcggccggggctgcccacagtggtgtgatgcgcacatcagagaaaccgaatccgcctcgggagatgagccaggcgatcatccacgctgcgaagatgatggcggtagcgatgacagcacgtatcgccgcagtatggtccgagagggcggtaacgactacagccccgatccatccggcccatccggtccacgctaggactgccggtatccatgtggtgatggcgtcaatgacggcaacccatgccccgatggtggctagcagagcccaggccggccaggtgggtgctggggcccacgctacggcggcgatcatggttgtcgcagatgcagcacagacagcgatcaagcttcggaggctgtaggtgtcgcggtagacgatcttgtcgggattggcggtagctggttctggcaggacgcgggtgagggcaggccatcctgcgaccgcaatagccgcgacggcgaccacccacacaatctgttgcatgggtctcatcatggcccatcatcgatgagtatgggtggccgacatggggtcactcgtagaggggatcgaggggtgtgcgggcgagcatggcttcctgtgtgccgagcatgagggtgccagaatcctcgccagccgattcccagtcgacgatgacctggtcgccgtcaacgctggattcggcgatggtcacccattctccgtcgatattgatgagcaccccagcggccagctccgtggcagcaaccgggtgaggtgggttgtagaagcggtcgatgtcgcaggcagggtcgtcgggttcctcgactaccggaggtggggtcgatctggctgtctcggtgtcgtcggccaggtcggctcccaggatgcgctcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccacgagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccaccgcggtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcataatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgacgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctttcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacagatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcaaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcggtattcccggtcagcatggcggttaggaagcctgaagaggcttgggcggccgggtcggcggtgcgaagctccgaggtgtctagggtgggggctgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatctgtgcatcgatatacctatgtatctgtctgtggtttttagaggccactcccgtcgccccgggccgctcagcgataccgcaaggctgtgtgggatcag

SEQ ID NO: 191 - DNA, 8556 bp, Propionibacterium acnes
tgacagcataacgggcctgcccttgaagggttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactcccccaccctcgtgtagtacactatactacacagtcattgaggatagaggtgacgtcatgagtttttcgatccgtttaaccgaccatgagcgccgcttagctgattcctacgcccgcctgcactcgcagtccctgagtgaggctttcaagcaagccctcttcgaccgcatcgccgacgagttcgatctgcaagtagcccgtgaggcactcaccgactacgcccgcgacaactaccagtctcgccccatcagcgagctatgggacgagtgtgacctatgagctggcagatcgaaaccacgagccggttcgataaagaattcaaaaagctagaccgctacacccaaaaactcattcacggctggatcacgaaaaacatcgacaacaccgacgatccccgccgccacggcaagcccctcaccggtgatctttccggactgtggcgctaccgcatcggcgactaccgcctcatctgcacactcaacgataaccgcctcaccatcctcgccctgtccatcggtcaccgccgcgacatctaccgataagccgttgcaagactgcggcgtcgacaccgccgggaccctggcccaggccttgggcctggaggaggacgagagcgaggagcacgccgcctgagcggtcgccggcacttcccataacagcaccggtcccggcggcccggccccgcgtctggtgctcggaccgatgccggcgcctggcctccgacgcccgccggggccagcggctgggctacctcgacgtcgacgtacaacgggccgaacgaaccgtgcgctgatttaccaccgcttccgcacagagaacatgcctctgactaggagaaatgacgttttccacagggcctctattactaatatccctattatctctatccacgcgcgcgagcctcagcgttcaagcttcaggtcttgctcgtctccctcgcgcctcgctgcgctcgttgctactgccgccccacccggcaagccgggtgggttgccatcggaataccgtggaccatcccggcgcatacacccagacggtccaagatccaatccacgctcacccgcgacgccgctaacgatcctcatacaccgtagatgccgttctgagagccttccagacccgcacgtgggtttattgcaccgagacccaaatcccctcagaagcgatcctgaaaccgtctacgccccatttccgacggacgctggacaggctgggcggcttgtctcccgccgcagacatggccctggcatatgcggttgccgactggtgggatcagggattggatcacacggcagacggctggtccaaggcgggtgtgcaggtgcggtgagcggcagacgtgaccggtggggtgcactgtcatggccgggcatctgccgagccaccatgcgggccctggaccaggaggcagcccgctgcgaggactgggggaagacggcggcacggatgggccgtcgggatgcggcggccgaattcaccgagactgcggtgcagcatcgtggacagatgcaccacctcatgtcggcacaaaaagtgtgggtgtcgaccgacatggtgtcggctacactggacgccgcaggagacgtgccgagtttcgaggccgtcgacgtccctgccgccgggctcatgggtttggccagccccctgccgccggttaccctgcagcatccgctgtatctgcgcagcgacgagggtgtgacaaccttcactgatccggttctcgtcgacgcgctgggatggtggatggattctgggcgtgtgcacgtggtgatgtgcacacgcacaccccggctgcccaacccggtttatgcggtggcctccccactgacggtggtggagaaaatcacggtgcccaccggcatcgagttcgagaccatggagtccaggatcctgacccccggcggcgtgacaggcgtctcacggcagggcacacgcatgatgatccggttggcgtcatggctgggtgccgcgtgggtgctcatggcgactccgacggtgtcggagccgcaccctatggatggccggtggggaggcccagcaacggggcagacccggccgcgtgatcgggtgaccgtggtcgacatgcggcccatgaggcaggtgcacaccaccaccgaccccaccggcaggcggttgacgacccggcatgtcgtgcgaggacactggacacaccaaccctacggcccggcccgcagtctccgacgcctgcagtgggtcgccccattcatccgcggccccgaaggggctccgttcgtcggcaccgacaccgtcaccgtatggcgccgctagatacgcgggcgcggggggttgacgaacgatgcccccctctttgtgttgtgatcagtcgtgatcggcgggttttaggtcggggtaggtgtcgagaatggccttgaggacgaggtcttggattgtggtgtcattctgggctgccttgaccttcagtccaacgccgatgtcccgggggattctggtctgcaacttgaacaggtctgcctccttggttttgaacagtttggctgcagggttggcaacgggctgttcttggcgctggcgtccaaggttgcttttctttcgggcggtcatgacatcatctccaacagttcgtcggcaacatcggcgaagaaggcgatagtttccggctcaggggtacagccgtaggcgcgcttgatgacttgacgcttggggatgacgtgatcgaccaactgcgtctgggagtcgttggctagaaggtcgcgaccttccttgaacagggaggtattcggttcagctttggaaagcagcaccacgcgcggggttcctgcggcggcgtcgtgcgtctcccaggtgcgcgccatgtcgagcccggacgtgtcggtggggatgataaccagatcggcggcgcgaatggcggcggtgatgatgtcaccgttgcccggcggggtgtcaatgatgacaacttcttcgggtccggcgacgaggtgctggagcgtcgccttgttggccggttccacggggaaccccaaggggtcggcgttactcagtgtgcactcggcccaggatgatgctgacccttgagggtcggcatctttgacgcggaccatacggcccgtctcatggagagctgcagccagcaggatcgctgccgtggtcttaccgacgccacccttggcgttgataatgctccagatcatggtgacacctttcagtgaggatgcatatcagtttacctgcaaggagtaaagacggcaagcagttatgccgtttctgcggcaagccgtcttgcatccttggatgtatagatagttgtctacttatggttgtggatcgtggtgtctcgtaccaggatttagtgtgctcgctgatatgcacgactttcgggcggcctgatctggcggtggtgccactaacccaggagtctgatccgcaaggtgtcctcgactttgaggaaggggtctctgctttcgtgttgacctaaagtcaacggccctgggcgatcactgaatcctaataactttgtatccttccctgattgcatcttagcatccttgaattcaaacagggatggagccatgctgttttgacgacatggatgcactggggtttggttgttgccgatgcggagcgtcaggcggcccgggacgccgccaccgccgacacgctgcgggagatcgtgggactgctgggccggggcggcgaggtcccgcccgccaagacggggcgtaagacgaccggcaggccggccccggcccgcaagtcgtcggccacgcagtaaaggcagggatccgtccctacgcagagagcggaggcagatcctgggggatccgactcttcggttccgtgatcttcccggagatcttcccggatcccccagggctcatcctgatacggggtccgccgacggaccccgtatcagtgggggcgctgccaccagtgatggcgggcgggtcggtcggcgtctaggccccgcccgatggtcgcctggtctacctcgcaggcccgtgctgttgccgaggccgagaacgtctgcccacttgttgccgattcagtcccctctccgtctgccatgtcgccaacctttcctatctggcgtgctcatggacatgcccgggcacgccctcgctgctcagaggcctgctcgttccacctctggccgcgaaccgtatttctgctgaccactcctcgtgcgtgaatatttgccagccttggccattcatatttggactactctgcaccagatatcggactgggaaacctcttgcacatctctaattgtcatctattcgttgggcgcgcgctgttagatcgtgatcataccaatcagaagacaaagcgacgcccttttgagcggcttttcgaacgattctagaccgcgctatatcagcatttctaccgcgcggccagagtgctacactaaattcctctctgcaatccttaagtccattctttacttcctcatccaatttctgcgacagcatttttatggaagcatcgcactctgactcatcatcaaatgcctcaattgcgtgcgttcgccattcacggcgcgtattatcgtagccgtaatgaagtattacccaccgatccacagaatcatcgttaggatctacaactgtcatgaatggcccaactctcgctctggtgtattctcaattgcagttcagtgactttacttgaccagtcccggatttagtagacgtagacggagagtaccccgccgggaacttgactgacatcactgctgtaccgtactgctttcccgggtggcaaccatcgtaagcagcatttgccgtgacgtacctagtgctctttctctgagtgccggtaatcgccttatatggtacaggtgggtgaatcgtagccgttacggctaccgatgacacgtttgcatcacatgaagctgtggcgacataattagttgtcccattgacatgatgagagtcgtggacatactgtcgaggatcgagagtgcaggttattgttgacgccgttgttctggtaccagctgctttcgagctctttgttgcagttacagtctgcggccctgaaggttttactgacgcgactgatgtgttcgcgtgttttgcggcagtgctttgatttggttgtgcttgtgtagcagttgctgatgtcgccagtgatgcccccattaccatagctgtgattatggcgtagtctttacgcttcattgcgcccccaaataagcatgttagtttgctattttgaataggaaacgagacatcgccatgacttgtcaagggcagaagtagaaagaatcggggggtatcaagaaagatgtgctttcatcaggacgaaagcggatgggtccgttcgacttggtgacgaatgatccggccttgcgtcgcggagaccaggccggcgagtttgtcgagcagggccgccgtggcctcatcgtcgggcacatcactaaagggacgaacaaccatgacggctagggccagaaacgaccggaactgaatcgcatgtggacccccatctggcaccaggcacacacctaccgaccggaaaccctgcaccctgtcgctcccagttcacctcctaatatgcgcctatagtctgtgctagtagacattattttgtgtgttgtttcccatctggcatgtctggccccggacccgccgcgacacgcggtggtggataacagaccaggacccccggaccatagagaccagggggacgagacagtcccccggtgaggatgtctcgatgtgcagatcaggaacagaatcgccgggcacgacccggcgccggtgccggtgcagtgaacccgtggcccatcgactccacgaacgaacgtctcgccttcctcaactggtgttggcggcaaggctactcagcagccatcgtggaaacgatggacgccgcgggagcctacgaccacctcgacgacgaccagaccagcaaccagcacgactaacgccgctcccagcacgggggaaggcggcgcaccaggtgcgccgccttcccccgtgctggtgtctcgtcggcttactggtgggggtcgtaggggaacccgtaggtgtgttccagggccttgcggagaaggtcgttcatagttgtgtgttcggcgacggccttcatcttcagcgccgtgtgggtggcggtgggtagcttgacgttgaacgcggtgatcggggtcttggccgactggaaggtttcagagacactggctccctggctggccgccatttggtcggcgtaacggctggctttgtcggcggcggtgggtttgcggttcttactcacttcagcatctccttgattcggtcggcaacctgggcgaactctcctagatctgttggccgggttccgatggcttgccgataggcgacccgtcgatgaacctccgcatcgagaacgtctaggccctcaacggcggcggccccctcgtgggcatcacggtattgcctggtccaatcggctttgttgaagagcagggcccggcgtgtgccgtgggccacctggtaggtcattagcgctcggtccatgtccaggtcccccgactcggtcgggatgatgaccacatcggcgatgtcgagggctgcggtgatcgtctgagagtcaccggggggagtgtcgatgatgacaaggtcggcgtcgatgtcacggcagcgcctgacgataggggcattagccgggcggacctcgaagcccagcgggtcaccagtctcgaaagcgtcggtagcccatgacgtcgccgatccttgcgggtcggcgtcaagcaagatgactcggtactgagctgctaaggccgttgccaggtagaccgccgtggtcgttttcccgaccccgcccttggtgttgacaatagaaatactacgcataaatacatcattacacatgtgcatcgatgtatctgtatatatgtgtatcggcgtgttgtgagggaaaacccgggccacatacaacgatcccccagccaccacagccgggggatctctcagtaaagccagcaactcccacagaagttgcacccccacgatacccaccacatccgtgtcaagcccccacaacacccaccagcgccctaggcttcccccatgaacattgacatggacacaccaaccgaaaccgaagccgacaccttcgatgccgtcctcgccgacattaaccacatcaaccgcctcaccgccgacgaaatcgagtgctactccatgggagcctgtctcctcctcctcaaccaccaccccttctccgaactccgccaacactgggccgacaaccccaccgacgaaaccacgtggaccctctacggggccatcatcgccgcctccaccctggacccccacctcagcatcgacgccctagcccgcctctaccagctccccctcgacctcgtgacccaagccctcaccgtctaagcgtcgatgagcgggggagaggtagcgcactatcggctaaggaaccccacaaacaccaaacccttgtcactgggaagggtttggtgttatgctggtctcacaactcaacagaggaggtgagacatgggaaatgagtaccagaagtcgctcaaagtcctgttcaagaaactggaatctgagcaaggagcccgcatcgagacccggcgcaaaggatggatgatctacccgccggatacgtcacgatcagcggtcatgatccacaagactccatcagatcgcagagcatgggccaacatgctttccgaactgagacgctcaggattcaccgtctaactcagtgaagggggctggagctccagccccctttcaaccacctcccccggacaccacacaagaaaaggagaacatgatgtggcacgttcggttgtcgcttcgcgcaatcagcgaggacatgctgttcgacgccctggacaccctcgaccccttatccccggtggccacactgggccccgatgagcacaccggatcattggcggtgttcgtcgaggctgactcactgacagacgccatcgagactgcccgcacagccatcaccaacgcatgcaacaccgccaccataaccggcgtagaagcccgccccgaagacgaatgcttcgcagacgttgaccggcccctgttcccgccagtggtcggatacaccgaaatcgctgaaaccgcaggactctcacgtcagcgcatccgccagctcgcaggcaccgccgggttccccgcacctgtcatcaagaccgcggccggcccgctgtttcccaaagccgccgccgagcagtgggcgcggacacgccagcctaaggcaggccgcccaaaactccagaccaccacctcataacacatcccgtgtgctgaacctgtt

SEQ ID NO: 192 - DNA, 3927 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggttcttgtctgcccagcgtttctcggcgatgtcgatcatgtcttggatggttttgacccatcctcggatgggatcgactttggtcagtttgatccctccaaggaactcgatgggcttagtaacgggcccgtcaggaccgaattcggtgtcccagccttcgtcgatggctagtttcagttcggcggcgtcaacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgtgagcttcggtggcgctgagcagagtggcgggtgcggcaccgatctctccggtcactgatccggcatacatgaatcggccgtcgatgtacacgaagttagggatagggccggcaggcacggtggggcgccaaccttgttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgccgcccccctagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcggtagctgggcatgtcaccctcccctatctgtcaaatgagctagacacagtgtctatttaatttgacgcaaagtcaagtgcattagacgcctttgtgtggatccgccccaccagacaaacactcgcgcctcatgacccgccgcgaagccttaacgaaaccaaaccgcttatagaaccgctccgcagcgctccccgagggctttagctccaaggtaagaccttgctcgtcggcccattggcagacttgtgtgaggatctgtgagccgtagccctgatttcggggggcggcatgcacgcacatcagcatgtgaccatgacggcgggtcggcgggctgacataagccccaccacgccagtccggtgtgatctgccaacttcgccatgccgcagcgcgccagcggcgggcctcggtagccaccatgatcaccatgatgatggacagggttacgacgccgactatggtcagctcactccagccaggccagttcccggagatgatccagcctcccagcgcccagatgatcatggcttccacgcccgccgcaatcgggacgagtggggcagtacggatgcggcctgccatgatctcggtgatctcgctgcgatgccatgacaaggagaattcccacgactcttgaatcatgctgatgtgtgaacggcttcctcggcttcgccctgccatagcttctctagacggcgctcggctagctcgtcggggcacggcgacagcctgccgcactcggagcagaccccgaagtggcgcgagagagtgatgaccggctcatcgggagcatgaaccgattcaacgaccgggtgctgctcatcggtgagtcctgaggcgtgaccaatctcggctagacggaggtgaaccataccgtcgtagtagtcgaggccttcaacgtggaacgggtaggagccgtccgcggtgtggcctgcaaccaggtccccgacttccagctgactggcggtcatggttcgcaccggcggcagcggggtccgggtcgcgttgatcctcatggtctctccttgcttctgcgccttcatagatgaaggtgccacagccggggttgatgtgcggaaccacagccactttttcaataaatccatcaccacggtctcaccccttcccaaatgtgtaaaccgtggtttacgctttaaggcatgatcgaacacacaccgacacccgccgcgcctcgcgtggccatcatttcccctagcgggccaccacggttcttggccgagcctcccagcgccgcgctgcgacgccatggtcggacccgcatgaggtcccttcccctatcccctcacattcgcgcctgggtctccaccagcggccgtaaacccaatcccatagccaccgccctgatctggatgcataccggagccctgctgccggtgtgggacaccgccgttttgactgggcctgccctcggcagacgtgtgcgccctctcagcagtgacgccgaactgacctctcggcggtggctcgaccaggttgccgaccatcccggctttctcgacacccttatcgaggccgcccgcatcaccgatggatggcatcacgcgacgcctccgcacattcaggccccttaccggacccttcatcagtgaacggaggtacaacgacatgaccagcgacattgacattgaccggacccacaaacccgacgaccgcgccgaggctcctctttaccggtcctgggccaggagactcgtgcacgtctccgggatgccctggcgtatcgtcgccgccttggccggggtctcccccacctccatgcaccggcttctattcggccgcaacggtcgacccgtggaatggatcggcatcaatgatgctcgcgccctgatggatatcggcatcgatgatctcgcctcagcgtccaccgaccgtatcccggcccgcgaatcccgcgagctgttggtagccctgcacaccctcggctggaccgatgagcatctaagccgctggctgaccagttccgacctcgacctgaccaccgcccccaaagccctctacgtcactcgactatccgccgcccgcatccaggccacctacgacatgctcatcagccagcccgtccgccgctgcggcc

SEQ ID NO: 193 - DNA, 2076 bp, Propionibacterium acnes
tggcgaaacgatcaggcgagccacgaccatcgccaagctgaatggagagcgagcatgagcaccacccctgccgggttcgacttcgacgctctggccgagtgggccgagagcgatgaggcgacccacaccccgcaaaccagccccgtgttccggggcaaggacgccgcgcgcgccagccgcgcattcctcggccgaggacggcccaccctcggctcagaccacgccaccggcgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcatgctttccggtgctgtcatgagcgtctgacaacagcgacacctcggggcagccgacggacagtcctctggctgccgctctgatcccatgcccacggcacgaaggtgtcggacagctcggtctcgtcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgccccgcctggtcctccagccacgacaacgcatcccgaaacagcccgacgtcttccaaagctaaaccacagtcgtagccgcccttgtcccccaaccgcacaatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacggtggtggggcaggtttgtgacctcgtgacgcagcaggttgcgcttgtgcatctgccgttcgagacgctcgggctgacctgttgacggggttgagccgtggcgccgcttcctcggcggggtctcgatccgttgctcttccggcggttcggcgtcaggttgtggtgcgcgatctcccctaggacgggggggctcgccacctatatccgagggacgatgagacggccttccacgcttgctgcgcactttcgcagcccgccccttgcggtcacatcgacgcggcggcggagtgacgtcctcaccgcgcgctaactgcgtcaacgccgccaccaggttggtgcccggtttcagccctttcagcacgaaccgcaccaggcgggggtctcggccgattcgtcgggcaatctcggcttggctccacccttcggctaacagggtgcgcaacaagtcttgggcccggttatcacgctcagtcactggtcgcctcctcggggagtcctgcctgctcggcctgctctgatagagcagcccgttccgatccggtctggggcgctttcaggggaccgggtaggacacctttgacacgcagtcgcccgtccttgccgtcgtcgccgcccccctgggccacagggagcgcccaggggggcacgttgctggtgtagatggcgtcgccgtggatagccagcagggtgcgggagttcatgcgtagtgctcctcccttggttgtggcgttttttccggtggtggggtcggcgatgggtgtgttgagggtgcgtacgcgggacagggcccagata

SEQ ID NO: 194 - DNA, 13067 bp, Propionibacterium acnes
ccgaaacgttccagcccgccctgttcgagctagccgactgcgcatgagaccccacacaaacatggttgaatcgaagggctcagccagcagccagttaccaggagtccccgtgcgtctataccgcgctgttcttacccacaccgacatccagatcaccgtccgcatctggagcaccaccgaccacgactggacctggactcccctcgacacctggacccccgacccgaccccgaccacaccagcccaactggccgacgaactccaccgacacggatggaccacccccgaggaccccaccaccctcaccaaggtgactgtgatccccgagaactggcaggccctcgtcgaccacgccctcgctgcccgaaaccaccaagccaaccagctgcgcgtcgccgagaacatcctcaccgacatcctcggcgacgccgccgacgccggcctgtctgtcaccgctctcgcccgcacgaccggactatcccgagtcgccgtctacaaacgcagcgccaaaaccatcgactccatgagacacgccacccaggccggcggaatcctcaccccctcctgtctcacccacgctgagagaacagcgctcggcctgcccgacgagtaacccatcgtttacatcctcgactggtccctgcgaccagtgaaccgtgcccccactgcgcccacaatgatcagcacacccacggcgatcatcaggtgggcagcactaactgatcccaacgaaccaagatcaaacaagccctgcccgggagcgtcgagcagtccgtgggcgcgaagccatgctccgagattgccaatgattttggggatcatcttgttcagtagggctatccctccgatgccgacaacgaggaagacgaggatttcttcgcctgcgttgtttcttcctgtgtttgcgatcatgctgccttctcggggtggatggccagccagctgatgaggttgtcggtgatctgccctgagatttggatcagttcgacttgcccggcctgccatgcccgtgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgccttgccttcttgcccgtggcgcttccgagatggggtcagtgggcgatggctaggccgatgagggcgccgctgcacaggctgggcgcccagggaaggaatcgggtggtgtggtgtcggaaccgatcgatgagggcatatagggcgatcagagtcagcccggcgatgaccgtggcgtggatcgtgtcgatgccggttgctgcggccggggctgcccacagcggtgtgatgcgcacatcagagaagccgaatccgcctcgggagatgacccagacgatcatccacgctgcgaagatgatggtggtagcgatgacagcacgtatcgccgcagtatggttcgcgagagcgatcatggccacagccccgatccatccaacccagccggtccaggcgagggctgccggtatccatgtggtgatggcgtcaatgacggcaacccatgccccgatggtggctagcagagcccaggccggccaggtgggtgctggggcccacgctacggcggcgatcatggttgtcgcagatgcagcacagacagcgatcaagcttcggagactgtaggtgtcgcggtaggcgatcttgtcggggctggcggtagctggttctggcaggatgtgggtgagggcaggccaccctgcggccgcaatagccgcgacggcgaccacccacacaatctgttgcatgggtctcatcatggcccatcaacgccgaaaatgggtggccgacatggggtcactcgtagaggggatcgaggggtgtgcgggcgagcatggcttcctgtgtgccgagcatgagggtgccagagtcgtcgccggccgattcccagtcgacgatgacctggtcgccgtcaacgctggattcggcgatggtcacccattgcccgtccatgtcgatgagcatcccggcggccagctctgtggcggcaaccgggtgggctgggctgtagaggaggtcgatgtcgcgggcagggtcgtcgggttcttcggttacctcgggtggggtcgatctggctgtctcggtgtcgtcggccaggtcggctcccaggatgcgctcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgaggacgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccaccgcggtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcataatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctttcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccaatcgccgacgccccttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacagatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggaggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcagtattcccggtcagcatggcggttaggaagcctgaagaggcttgggcggccgggtcggcggtgcgaagctccgaggtgtctagggtgggggccgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgagacgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctgga

SEQ ID NO: 195 - DNA, 9465 bp, Propionibacterium acnes
tgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatgaccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcgtatcttctagcaattgatctagctatgtatatagctgatgatctagctaccatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgaaagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgtcgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgagacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccggcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccatgctatgcagtcgggtacaggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgttgaccccgctcatgcctggttcggccgccgacgagctgtctcacttcgcccgagacctggattactgcgaggcccactcatgaacactcccgcactaaccagcgccctcatcgtgaccgggttggggctgatcctggccatcgacgggctggtcccggcgccgcctcgacctggtgccccgctgagcccggcccaaaggtgggccaggctcacccaccgtcccacaggagcggccgggcgccgccgggacctgcgctgggggctggctgttctcgtcggcgtcgtgctgtttgtgctcaccgggtgggtcgctgcgctggcgttgggccccatcatcgtgctgctggcccccaccctgctgggggcggccccaccaaccgacatcccgctgatggaggcgctggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcacccgcggggagcctcgacaacgttgaaagctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgacgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttacgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacaccgtgtcgagcccccatatgggccgcgaacctttcataaagatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaagctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggcggagcaagtctaagcgtcgaggtgctcatgtgggcgccgatcgcgctggtgatcatcgggtttgttgtgggtatcggccggatgtcgatggcccaggacgcggtgagtggcgcggctggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttggattcgggtcccggacggtgcacgcaacggggtctgccccggtagacacctatcgggaaaggagaggctgagatggcccgcgatgagcgtggtggcggctcggtgtcggtgtggatgctgctcatggtgccagtaattctggtcatggccggcctggtttttgacgggtcccgtcagatatcggcaacccaggcggcccaggacgcggcggttgcggcatcccgcgccggaactgatgcggcagcgacaccgcagctagctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttacccgccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcaaggcagcggctgcactggcacatgcccggccctcgcctagtgcgccgagtggcagccggtctcctcattgccgcgttcgcggccgcaccggcagccacaagcacggctcacgccgccgagaccacccatgtggcggtcgccgcccaggctggaccggcacacgcggccggcacccaggacagccccgccaccacctctcaggccccggacgcctccaccactccgaaaatctggaagacctacacggtgcgggccaacgactacctgtggaagatcgccgagcactactacggt

SEQ ID NO: 196 - DNA, 3127 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggtttttgtctgcccagcgtttctcggcgatgtcgatcatgtcttggatggttttgacccatcctcggatgggatcgactttggtcagtttgatcccttcgaggaactcgatgggctgggtgatgggcccatcaggaccgaattcagtgtcccagccttcgtcgatggctagtttcagttcggcggcgtcaacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccaaccttgttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgccgcccccctagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcggtagctgggcatgtcaccctcccctatctgtcaaatgagctagacacagtgtctatttaatttgacgcaaagtcaagtgcgctagacgcctttgtgtggatccgcccgcccagacaggcactcacgtctcatgacccgccgcgacgtcttaacgaaaccaaaccgcttatagaaccgctccgcagcgctccccgagggctttagctccaaggtaagaccttgctggtcggcccattggcagacttgggtgaggatgtgtgatccgtagccctgatttcggggggcggcatgcacgcacatcagcatgtgaccatgacggcgggtcggcgggctgacataagccccaccacgccagtccggtgtgatctgccaacttcgccatgccgcagcgcgccagcggcgggcctcggtagccaccatgatcaccatgatgatggacagggttacgacgccgactatggtcagctcactccagccaggccagttcccgcagatgatccagcctcccagcgcccagatgatcatggcttccacgcccgccgcaatcgggacgagtggggcagtacggatgcggcctgccatgatctcggtgatctcgctgcgatgccatgacaaggagaattcccacgactcttgaatcatgctgatgtgtgaacggcttcctcggcttcgctttgccatagcttctctagacggcgctcggctagctcgtcggggcacggcgacagcctgccgcactcggagcagaccccgaagtggcgcgagagagtgatgaccggctcatcgggagcatgaaccgactcaacgaccgggtgctgctcatcggtgagtcccgaagcgtgaccaatctcggctagacggaggtgaaccataccgtcgtagtagtcgaggccttcaacgtggaacgggtaggagccgtccgcggtgtggcctgcaaccaggtccccgacttccagctgactggcggtcatggttcgcaccggcggcagcggggtccgggtcgcgttgatcctcatggtctctccttgcttctgcgccttcatagatgaaggtgccacagccggggttgatgtgcggaaccacagccactttttcagcagatccatcaccacggtctcaccccttcccaaatgtgtaaaccatgatttacacatttggggcatgatcgaacccacaaccatctccaccacgccccgcgtggccatcatctcccccagcgggccaccacggttcttggccgagcctcccagcatcgcactgcgccgacacggccggtcccccatgaggtcccttcc

SEQ ID NO: 197 - DNA, 1732 bp, Propionibacterium acnes
tcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcctgctttccggtgctgtcatgagcgtctgacaacagcgacacctcggggcagccgacggacagtcctctggctgccgctctgatcccatgcccacggcacgaaggtgtcggacagctcggtctcgtcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgacccgcctggtcctctagccacgacaacgcatcccgaaacagcccgacgtcttccaaagctaaaccacagtcgtagccgcccttgtcccccaaccgcacaatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacgacgatgggggaggttggtgacctcgtgacgcagcaggttgcgcttgtgcatctgctgatcgagacgctcgggctgacctgttgacggggttgagccgtggcgccgcttcctcggcggggtctcgatccgttgctcttccggcggttcggcgtcaggttgtggtgcgcgatctcccctaggacgggggggctcgccacctatatccgagggacgatgagacggccttccacgcttgctgcgcactttcgcagcccgccccttgcggtcacatcgacgcggcggcggggtaacctcctcgccccgctccaactgtgttaacgcctcgaccaggttggtgccaggcttaagcccttttagcacgaaccgcaccaggcgggggtctcggccgattcgtcgggcaatctcggcttggctccacccttcggctaacagggtgcgcaccaggtcctgagcccgattgtcacgctcagtcactggtcgcctcctcggggagtcctacttgctcggcctgctctgatagagcagcccgttccgatccggtctggggcgctttcaggggaccgggtaggacacctttgacacgcagtcgcccgtccttgccgtcgtcgccgcccccctgggccacagggagcgcccaggggggcacgttgctggtgtagatggcgtcgccgtggatagccagcagggtgcgggagttcatgcgtagtgctcctcccttggttgtggcgttttttccggtggtggggtcggcgatgggtgtgttgagggtgcgtacgcgggacagggcccagat

SEQ ID NO: 198 - DNA, 718 bp, Propionibacterium acnes
ccggggccctgctgccggtgtgggacaccgccgttttgactgggcctgccctcggcagacgtgtgcgccctctcagcagtgacgccgaactgacctctcggcggtggctcgaccaggtcgccgaccatcccggcttcctcgacacccttatcgaggccgcccgcatcaccgagggatggcatcacgcaacacctccgcacattcaggccccttaccggacccttcatcagtgaacggaggtacaacgacatgaccagcgacattgacattgaccggacccacaaacccgacgaccgcgccgaggctcctctttaccggtcctgggccaggagactcgtgcacgtctccgggatgccctggcgtatcgtcgccgccttggccggggtctcccccacctccatgcaccggcttctattcggccgcaacggtcgacccgtggaatggatcggcatcaatgatgctcgcgccctgatggatatcggcatcgatgatctcgcctcagcgtccaccgaccgtatcccggcccgcgaatcccgcgagctgttggtagccctgcacaccctcggctggaccaacgcgcacttgagccgctggctgaccagctccgacctcgacctgaccaccacccccaaagccctctacgtcacccggctatccgccgcccgcatccaggccacctacgacatgctcatcagccaacccgtccgccgctgcggcc

SEQ ID NO: 199 - DNA, 12176 bp, Propionibacterium acnes
aaccgtcatctggcgtggagtagcgagctgatgcaggaaggcaatttgtacggccttcccgaggaagacccgttgtggggcgaggccgtggagctggtagcgggacttatcccctctgtgcgggcgatgtggtcgcacgatgggcagaccgtgactgtgtcggctggccggcgggtggcgacactggggatgccgatgcggggatggcgtggtatcgagatgcgcggctggaatccagtgggcgccgatacgtggtggatcgttgaccaggtgggtagttggctggtcgatcaggatgagccgatggtcgttgacgggagggtgctccatgaggcgtgggaacggtcgcagatggtccgttcaggccgctgagaaaaaatttaggtccgccctgcatatctccgccctgcatatcggggcctcttcataccttcaaaagtgtgaagggaatacagactcttcgactggaattaaaatggtatatggcgtgtccggtccgcacccagctccacgatgcgccataggggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgacgtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggattggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagatgcgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagacctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgaggcgtcctcccggagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcgggggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctatgtccatcgtggctcggttcctgggctgttcttcgcgccaggtctctcatatccgtggggctctcgttgatgccggtctgctcggctgtgacgaggtgtcgggggcggcgagccgggtgtggttcccctcgatggccgaggagtgtgcagcggatcgtgaggtggttgatggggccgtcgtcggtgctggggtgggctctggtgaaggtgtcgaggagggcggggaacccctgtcgattttgtccacccacccctgtcgattttgtccacccacccctgtcgattttgtccgccaagtattagacaaaccattagacagtgaattagaccttgggtcgcgtcagcgtgttagctcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcggttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcatggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccaccaggcccgagacaccctcacccacgacaacccccatgaacgccgcctggcccgcgaacaccaccgcgcccaactcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacacacaccgtgaaacacgacaagccacctgacagtatcagctgcaagacgcatgacaacatagaagggcatgatgaaatacacatagacacaaccccgcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgcttggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaaaccgacccattcgcccgccagaaagcagcagaagaccgcgcccaccaactccaagacgaagcccaacgccacgcccaccccaaacgcgtcatcggccccaccgcacgattccagttcgtcctgccagccgacgtgctcaccggcctcaaacacctcgccctcacccgcggcaccaccgcccgccaactcaccctcgacgccctcgacaccgcctacggcctcgacaccctcgccaacagcgggaagaaaacccacccatgacccgtgggtccccctgccaccaccccctcgacggcaactgtgtgcgagccacaggcccgcacacaggcggcagcccagtgccgtccccgccaggaaaggaactgaacttttctggagtgctggctccctatcaccccttatggtgctatcagatccagtagcgccagcccgagaggaaacccatgagctacatcgtccgcaccggaaatctagccggcacccccgagctgcgcgaggggtagccgacacggcggaccgtgcccctgacagtaagcggcactactggagacatcaccatgaccgctcagatcctcgccccgtgcaaccagaaggctgccgtcatcgaaggagccctgccatgaaccaacctaccccccacaaggccgacgagttacagacgagcaacaccacgaggaagtggcggcacaaggtgtcgttctaccaagacccggccgacaccgaccgagtccgcggagcgatcctccacaccatgacaaccgaaggcaaccggaacctgagccagttcgtcaacgatgccgtcatggccaaggtgaccgaactggaagcaaaatacaaccacggcgagccattccccgccgtgggagcccgaggactcccccagggcggcgcagccgccaacagataagagggcggggaccaccaatagcagtcgatttcggatccagatcgggtagacaggacccatgatgaatttcatatcctccctgctctcggccatcctgaccctctttgcgatggtagccgtggcgataggagtggtgaacattgtgccgggaatatgcgccatcatcggtgcacggaaatacggcgaccaggaccgtgtgcgggcaggacaacgaaagatccttcttggtgctatcgccttggtggtagcagtaggcattcacccgtgacccacggttaccggaagccccgccgcaatcgataccactgtcagtaccatcaggggcgataggggtcaagctctccttgtcacaatcccttccccggcagcccagtaaccgtcgcttacagccatacatggatatgcgcccattcgtcggcaccgacgccgtgcgggttggcgacgctgacccgtctgctcacaaacgacccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgaggccaggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtaaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgttggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagccgttgcatgagacgacgcctccgcccgccacaccaacggtcaccgccacggccacggtgaccgtgaccgtg

SEQ ID NO: 200 - DNA, 7612 bp, Propionibacterium acnes
ggttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactccccccgccctcgtgtagtacactgtactacagatgtcttaagaataatcccgaggtgacgtcatgagtttttcgatccgtttaaccgaccatgagcgccgcttagctgattcctacgcccgcctgcactcgcagtccctgagtgaggctttcaagcaagccctcttcgaccgcatcgccgacgagttcgatctgcaagtagcccgtgaggcactcaccgactacgcccgcgacaactaccagtctcgccccatcagcgagctatgggacgagtgtgacctatgagctggcagatcgaaaccacgagccggttcgataaagaattcaaaaagctagaccgctacacccaaaaactcattcacggctggatcacgaaaaacatcgacaacaccgacgatccccgccgccacggcaagcccctcaccggtgatctttccggactgtggcgctaccgcatcggcgactaccgcctcatatgcacactcaacgataaccgcctcaccatcctcgccctgtccatcggtcaccgccgcgacatctaccgataagccgttgcaagactgcggcgtcgacaccgccgggaccctggcccaggccttgggcctggaggaggacgagagcgaggagcacgccgcctgagcggtcgccggcacttcccataacagcaccggtcccggcggcccggccccgcgtctggtgctcggaccgatgccggcgcctggcctccgacgcccgccggggccagcggctgggctacctcgacgtcgacgtacaacgggccgaacgaaccgtgcgctgatttaccaccgcttttgcgctgatttaccaccgcttccgcacagagaacatgcctctgactaggagaaatgacgttttccacagggcctctattactaatatccctattatctctatccacgcgcgcgagcctcagcgttcaagcttcaggtcttgctcgtctccctcgcgcctcgctgcgctcgttgctactgccgccccacccggcaagccgggtgggttgccatcggaataccgtggaccatcccggcgcatacacccagacggtccaagatccaatccacgctcacccgcgacgccgctaacgatcctcatacaccgtagatgccgttctgagagccttccagacccgcacgtgggtttattgcaccgagacccaaatcccctcagaagcgatcctgaaaccgtctacgccccatttccgacggacgctggacaggctgggcggcttgtctcccgccgcagacatggccctggcatatgcggttgccgactggtgggatcagggattggatcacacggcagacggctggtccaaggcgggtgtgcaggtgcggtgagcggcagacgtgaccggtggggtgcactgtcatggccgggcatctgccgagccaccatgcgggccctggaccaggaggcagcccgctgcgaggactgggggaagacggcggcacggatgggccgtcgggatgcggcggccgaattcaccgagactgcggtgcagcatcgtggacagatgcaccacctcatgtcggcacaaaaagtgtgggtgtcgaccgacatggtgtcggctacactggacgccgcaggagacgtgccgagtttcgaggccgtcgacgtccctgccgccgggctcatgggtttggccagccccctgccgccggttaccctgcagcatccgctgtatctgcgcagcgacgagggtgtgacaaccttcactgatccggttctcgtcgacgcgctgggatggtggatggattctgggcgtgtgcacgtggtgatgtgcacacgcataccccggctgcccaacccggtttatgcggtggcctccccactgacggtggtggagaaaatcacggtgcccaccggcatcgagttcgagaccatggagtccaggatcctgacccccggcggcgtgacaggcgtctcacggcagggcacacgcatgatgatccggttggcgtcatggctgggtgccgcgtgggtgctcatggcgactccgacggtgtcggagccgcaccctatggatggccggtggggaggcccagcaacggggcagacccggccgcgtgatcgggtgaccgtggtcgacatgcggcccatgaggcaggtgcacaccaccaccgaccccactggcaggcggttgacgacccggcatgtcgtgcgaggacactggacacaccaaccctacggcccggcccgcagtctccgacgcctgcagtgggtcgccccattcatccgcggccccgaaggggctccgttcgtcggcaccgacaccgtcaccgtatggcgccgctagatacgcgggcgcggggggttgacgaacgatgcccccctctttgtgttgtgatcagtcgtgatcggcgggttttaggtcggggtaggtgtcgagaatggccttgaggacgaggtcttggattgtggtgtcattctgggctgccttgaccttcagtccaacgccgatgtcccgggggattctggtctgcaacttgaacaggtctgcctccttggttttgaacagtttggctgcagggttggcaacgggctgttcttggcgctggcgtccaaggttgcttttctttcgggcggtcatgacatcatctccaacagttcgtcggcaacatcggcgaagaaggcgatagtttccggctcaggggtacagccgtaggcgcgcttgatgacttgacgcttggggatgacgtgatcgaccaactgcgtctgggagtcgttggctagaaggtcgcgaccttccttgaacagggaggtattcggttcagctttggaaagcagcaccacgcgcggggttcctgcggcggcgtcgtgcgtctcccaggtgcgcgccatgtcgagcccggacgtgtcggtggggatgataaccagatcggcggcgcgaatggcggcggtgatgatgtcaccgttgcccggcggggtgtcaatgatgacaacttcttcgggtccggcgacgaggtgctggagcgtcgccttgttggccggttccacggggaaccccaaggggtcggcgttactcagtgtgcactcggcccaggatgatgctgacccttgagggtcggcatctttgacgcggaccatacggcccgtctcatggagagctgcagccagcaggatcgctgccgtggtcttaccgacgccacccttggcgttgataatgctccagatcatggtgacacctttcagtgaggatgcatatcagtttacctgcaaggagtaaagacggcaagcagttatgccgtttctgcggcaagccgtcttgcatccttggatgtatagatagttgtctacttatggttgtggatcgtggtgtctcgtaccaggatttagtgtgctcgctgatatgcacgactttcgggcggcctgatctggcggtggtgccactaacccaggagtctgatccgcaaggtgtcctcgactttgaggaaggggtctctgctttcgtgttgacctaaagtcaacggccctgggcgatcactgaatcctaataactttgtatccttccctgattgcatcttagcatccttgaattcaaacagggatggagccatgctgttttgacgacatggatgcactggggtttggttgttgccgatgcggagcgtcaggcggcccgggacgccgccaccgccgacacgctgcgggagatcgtgggactgctgggccggggcggcgaggtcccgcccgccaagacggggcgtaagacgaccggcaggccggccccggcccgcaagtcgtcggccacgcagtaaaggcagggatccgtccctacgcagagagcggaggcagatcctgggggatccgactcttcggttccgtgatcttcccggagatcttcccggatcccccagggctcatcctgatacggggtccgccgacggaccccgtatcagtgggggcgctgccaccagtgatggcgggcgggtcggtcggcgtctaggccccgcccgatggtcgcctggtctacctcgcaggcccgtgctgttgccgaggccgagaacgtctgcccacttgttgccgattcagtcccctctccgtctgccatgtcgccaacctttcctatctggcgtgctcatggacatgcccgggcacgccctcgctgctcagaggcctgctcgttccacctctggccgcgaaccgtatttctgctgaccactcctcgtgcgtgaatatttgccagccttggccattcatatttggactactctgcaccagatatcggactgggaaacctcttgcacatctctaattgtcatctattcgttgggcgcgcgctgttagatcgtgatcataccaatcagaagacaaagcgacgcccttttgagcggcttttcgaacgattctagaccgcgctatatcagcatttctaccgcgcggccagagtgctacactaaattcctctctgcaatccttaagtccattctttacttcctcatccaatttctgcgacagcatttttatggaagcatcgcactctgactcatcatcaaatgcctcaattgcgtgcgttcgccattcacggcgcgtattatcgtagccgtaatgaagtattacccaccgatccacagaatcatcgttaggatctacaactgtcatgaatggcccaactctcgctctggtgtattctcaattgcagttcagtgactttacttgaccagtcccggatttagtagacgtagacggagagtaccccgccgggaacttgactgacatcactgctgtaccgtactgctttcccgggtggcaaccatcgtaagcagcatttgccgtgacgtacctagtgctctttctctgagtgccggtaatcgccttatatggtacaggtgggtgaatcgtagccgttacggctaccgatgacacgtttgcatcacatgaagctgtggcgacataattagttgtcccattgacatgatgagagtcgtggacatactgtcgaggatcgagagtgcaggttattgttgacgccgttgttctggtaccagctgctttcgagctctttgttgcagttacagtctgcggccctgaaggttttactgacgcgactgatgtgttcgcgtgttttgcggcagtgctttgatttggttgtgcttgtgtagcagttgctgatgtcgccagtgatgcccccattaccatagctgtgattatggcgtagtctttacgcttcattgcgcccccaaataagcatgttagtttgctattttgaataggatacgagacatcgccatgacttgtcaagggcagaagtagaaagaatcggggggtatcaagaaagatgtgctttcatcaggacgaaagcggatgggtccgttcgacttggtgacgaatgatccggccttgcgtcgcggagaccaggccggcgagtttgtcgagcagggccgccgtggcctcatcgtcgggcacatcactaaagggacgaacaaccatgacggctagggccagaaacgaccggaactgaatcgcatgtggacccccatctggcaccaggcacacacctaccgaccggaaaccctgcaccctgtcgctcccagttcacctcctaatatgcgcctatagtctgtgctagtagacattattttgtgtgttgtttcccatctggcatgtctggccccggacccgccgcgacacgcggtggtggataacagaccaggacccccggaccatagagaccagggggacgagacagtcccccggtgaggatgtctcgatgtgcagatcaggaacagaatcgccgggcacgacccggcgccggtgccggtgcagtgaacccgtggcccatcgactccacgaacgaacgtctcgccttcctcaactggtgttggcggcaaggctactcagcagccatcgtggaaacgatggacgccgcgggagcctacgaccacctcgacgacgaccagaccagcaaccagcacgactaacgccgctcccagcacgggggaaggcggcgcaccaggtgcgccgccttcccccgtgctggtgtctcgtcggcttactggtgggggtcgtaggggaacccgtaggtgtgttccagggccttgcggagaaggtcgttcatagttgtgtgttcggcgacggccttcatcttcagcgccgtgtgggtggcggtgggtagcttgacgttgaacgcggtgatcggggtcttggccgactggaaggtttcagagacactggctccctggctggccgccatttggtcggcgtaacggctggctttgtcggcggcggtgggtttgcggttcttactcacttcagcatctccttgattcggtcggcaacctgggcgaactctcctagatctgttggccgggttccgatggcttgccgataggcgacccgtcgatgaacctccgcatcgagaacgtctaggccctcaacggcggcggccccctcgtgggcatcacggtattgcctggtccaatcggctttgttgaagagcagggcccggcgtgtgccgtgggccacctggtaggtcattagcgctcggtccatgtccaggtcccccgactcggtcgggatgatgaccacatcggcgatgtcgagggctgcggtgatcgtctgagagtcaccggggggagtgtcgatgatgacaaggtcggcgtcgatgtcacggcagcgcctgacgataggggcattagccgggcggacctcgaagcccagcgggtcaccagtctcgaaagcgtcggtagcccatgacgtcgccgatccttgcgggtcggcgtcaagcaagatgactcggtactgagctgctaaggccgttgccaggtagaccgccgtggtcgttttcccgaccccgcccttggtgttgacaatagaaatactacgcataaatacatcattacacatgcgcatcgatgtatctgtatatatgtgtatcggcgtgttgcgaggggaaaccccagcccacatacaacgatcccccagccaccacagccgggggatctctcagtaaagccagcaactcccacagaagttgcacccccacgatacccaccacatccgtgtcaagcccccacaacacccaccagcgccctaggcttcccccatgaacattgacatggacgcaccaaccgaaaccgaagccgacaccttcgatgccgtcctcgccgacattaaccacatcaaccgcctcaccgccgacgaaatcgaggactactccatgggagcctgcctcctcctcaaccaccaccccttctccgaactccgccaacactgggccgacaaccccaccgacgaaaccacgtggaccctctacgggaccatcatcgccgcctccaccctggacccccacctcagcatcgacgccctcgcccgcttctaccaactccccc

SEQ ID NO: 201 - DNA, 4261 bp, Propionibacterium acnes
gacgccggccaccccaactactccgacccacacggtgaccccagctccggcctctgccggccactcgaccagcgacgagcacccactccatacggataccgccacagcggacaaggccagcaacgaggacgccctgtccccaatccaggtgggcttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccagaccaccaaccaggttcgcgtcgacaccgaccaacccggcaccgacacccccttccccatcgacgacatcgacccgctgagctccgaccacccggtcctatccatcatcggccaccccgacatcacaggtgccactggaaccgttgggcgctccccgtggcgctgccaacagttggccctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccgtctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggggacctggggctggcccggtgggcgttgacccaagggctactggtgtctcccgatcatgaggacctggtcaccggttgtctgcgcaccgagtaccaggccggcaacatggacaaggtttccgagctggtcgatcacctgtcggctaccgcacgacgcctgggcgtcgatttgagcgccgacaccacccggatcatcgactccgttattacccatacacgcaggagagcatcatgatctcccgttgcactcatctccgtcaggaaggttcctatgcaccattatcgtcttggtatcggcactgccctcatcgcggtagcagccgtggccggctgtcgctcaacagactcgacacccacaccacctccatcccgtgtctccgccacgacatcagcgagctctaccctcagcccgaccccgtcagccggagcgatcagtgccgccgacgccgaaaacatctaccgcaccgtccaagctaacaagatcgcactgtacaaaaagggtggcctggcacccggggaacccgcacccgcgacactgtcgaactacgccaccggccaggctctcaccgactacatgacctacatgcaccaaatctcggggcagggcatcaaaatcacatcggggaactcctcggttaccgcggtgcgggagaaaaagggtgataccacctaccccgaagccgctatcgccttggaatcgtgcgaagacgacagttcgattcgtaccgtggaccgccacggaaaggctgatcatggacgcattttccatgtcgacagttggtatgcccgcgataagaagggcaccgtcaagatgatcgcattcaactcaacggaggtccccacatgcgacgtcaagtaatcaccgcggccgtactgggcctggccctggccaccacctccctgcccgccctcgcaggcggcggcgacttgaacggcagtgtggacacggatggccctggttacgatgtgcgtactgaggtggattaccatcacaccaccggtggtgcgggtgggggtgccacgacagggggccatcatgggggcaaaacccacggtgatggtgaaggtgaggctattgatgggcgttctcgcgccgatgccgaagccgaactagacgaagccgaccgtaaccaggacttgacttgtgatgtcttgctcccaccggcgccgaataccccagccggccaggaatgggcgaaagaatgcaatcccccagcgaaaaaggggcagaaggccaccccgaagcccgatccggtgttagtgggccgtcacgcggccttgcagctcacccttcccggcgcggcccctcgtatcgatccgtcccccgaccttaaccggtggcactcggcagcagtgggccaggctttgtggttgtcggttgatgaccccaccgccactacgcagaaatcgatcacgtttatgggccaggttgtctcgttgagcgccaaacgtaacggtttgtcgtttgatatgggtgatggtcatgtcgtgcactgtgatgccacgacgacatggacggagtcggtggaaccggggaccccctcacccacgtgcggttacacctaccaacaggcagccccggccgggggctataaggtcaccgcaatcacgtcgtgggatgtgacctggtcggtactaggacacacgggcacagtccacatccagaaggccggtgggcagatgcttccggtcggcgagttggagtctgttgttacacggcgatgactcctgatagtccgacgctgtatgaggtgttggaggtctgccctgatgccactgatgaccagatcaagacggcgtggcgtcgtgccgcgaaagtgactcaccctgatgccggtggcactagtgaggcgttcgcggccgcccggcacgcctgggaggtgttgtctgatcctgcccggcgcaccgcctacgatgccgacctggcgggggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcggtgacgggtctggcatttttcaccatggcggccatctggtgtggatggtcgttgataggtggtgcgttgctgtggggccagacgtc

SEQ ID NO: 202 - DNA, 12448 bp, Propionibacterium acnes
cccatcgtttacatcctcgactggtccctgcgaccagtgaaccgtgcccccactgcgcccacaatgatcagcacacccacggcgatcatcaggtgggcagcactaactgatcccaacggaccaagatcaaacaagccctgcccgggagcgtcgagcagtccgtgggcgcgaagccatgctccgagatgaccgatgattttaggggccatcttcttcagcagggctatccctccgataccaacaacgatgaaggcgaggatttcttcgcatccgttgtttccttctccggtggggccgttcatgctgccttctcggggtggacggccagccagccgatgaggttgtcggcgatctgccctgagatttggatcagttcgacttgcccggcctgccatgcccgcgatgcgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacagcagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgctttgccttcttgtcagtggcgtttccgagatggggtcagtgggcgatggctaggccgatgagggcgccgctgcacaggctgggtgcccaggggaggaatcgggtggtgtggtgtcggaaccggtcgattagggcatatagggcgatcagggtgaggccggctatgaccgtggcgtggatcgtgtcgatgccggttgctgcgaccggggctgcccacagtggtgtgatgcgcacgtcggagaagccgaagccgcctcgggagatgagccaggcgatcatccacgctgcgaagatgatggtggtagcgatgacagcacgtgttgccgcagtctggtccgagagggcggtaacggctacagccccgatccatccggcccatccggtccacgctagggctgccggtatccatgtggtgatggcgtcaatgacggcaacccatgccccgatggtggctagcagggcccacgtcggccacgtgggtgctggggcccacattgtggcggcgatcatggtgaccgcagccgcggcacagaccgcgatcaagcttcggagactgtaggtgtcgcggtaggcgattttgtcgggggtggcggtggccggttcgggcaggatgcgagtgagggagggccatcctgcggtcgcaatggtcacgacggcggcgatccacacgatctggtgcatgggtctcatcatggcccaatatcgatgggtgtgggtggccgacatgggctcagtcgtcgagaggtttgcgggcggttgtggcttcttgggtgccgaggatgagggtgccggagtcgtcgccggctgattcccagtcgacgatgacctggtcgccgtcaacgctggattcggcgatggtcacccattgcccgtccatgtcgatgagcatcccggcggccaggtctgtgacggcaaccgggtggggtgggctgtagaggaggtcgatgtcgcgggcagggtcgtcgggttcttcggttacctcgggtggggtcgatctggctgtctcggtgtcgtcggccaggtccgctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgcctcggccgcgtttgccgaacgggatgcccacgccgatgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcttcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtagggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccaccgcggtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctttcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccaatcgccgacgccccttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacagatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcattgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcagtattcccggtcagcatggcggttaggaagcctgaagaggcttgggcggccgggtcggcggtgcgaagctccgaggtgtctaaggtgggggccgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctgga

SEQ ID NO: 203 - DNA, 9476 bp, Propionibacterium acnes
tgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaattgatctagctatgtatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggttggggctgatcctggccatcgacgggctggtcccggcgccgcctcgacctggtgccccgctgagcccggcccagaggtgggctcggctcacccaccgtcccacaggagcggccgggcgtcgccgggatttgcgttgggggttggctgttctcgtcggcgtcgtgctgtttgtgctcaccgggtgggtggctgcgctggcgttgggccccatcattgtgttgttggcccccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgaatggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtgacggcgcc

SEQ ID NO: 204 - DNA, 12539 bp, Propionibacterium acnes
ccccaatgcccccacaacgatcagcacaccaacagcgatcatcaggtgggcagcactaactgatcccaacggaccaagatcaaacaagccctgcccgggagcgccgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaaggttccctagacccggccgatgtgcggttctgtgggaaaaatgcttcccattggtccgtcttagttaggaaacttggcctaagtgctgtcgagggtcgcgtgttcgtgaccggttcgaagacactgccgccttgccttcttgcccgtggcgtttccgagatggggtcagtgggcgatggctaggccgatgagggcgccgctgcacaggctgggtgcccaggggaggaatcgggtggtgtggtgtcggcagcggtcgatgagggcatatagggcgatcagagtcagcccggctatgacagtgacctggatcgtgtcgatgccggttgctgcggccggggctgcccacagtggtgtgatgcgcacgtcggagaagccgaagccgcctcgggagatgagccaggcgatcatccacgctgcgaagatgatggcggtagcgatgacagcacgtatcgccgcagtatggtccgagagggcggtaacgactacagccccgatccatccggcccatccggtccacgctaggactgccggtatccatgtggtgatggcgtcaatgacggcaacccatgccccgatggtggctagcagggcccacgtcggccacgtgggtgctggggcccacattgtggcggcgatcatggtgaccgcagccgcggcacagaccgcgatcaagcttcggagactgtaggtgtcgcggtagacgatcttgtcggggctggcggtagctggttcgggcaggacgcgggtgagggcaggccatcctgcgaccgcaatagccgcgacggcgaccacccacacgatctgttgcatgggtctcatcatggcccatcatcgatgagtatgggtggccgacatggggtcactcgtagaggggatcgaggggtgtgcgggcgagcatggcttcctgtgtgccgagcatgagggtgccagaatcctcgccagccgattcccagtcgacgatgacctggtcgccgtcaacgctggattcggcgatggtcacccattgcccgtccatgtcgatgagcatcccggcggccagctctgtggcggcaaccgggtgggctgggctgtagaggaggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggattcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggcccgccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcaccaacagtcggggcagacgctggccgcttcgagaccgaggagggacgagacaagggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcaccacggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacagcagtgccgactttctgctggtcggcggcggtgcggggaaggctaatgccgatacgccggtacagcgccgaggtcaggcctgagcagtcgtagccgccatcggctttgccgttaccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtggcccgtcgttgccctcaccggtgcatccttgccctggcgggtctgcttcgcgatcgccgacatgccgcctcgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccgatccggtgagcttgcgaccaccactgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacataaacgccgaccacaccaacttgcacacgtagaaccagcacatgcccgcgaacaccagcaggaccacagccaaacccgccaccgtcgacgagtaaaagaagaaacccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactagtaatcatccgagacagcgccacaccgaactgctgggtgcgagccaacggagtagccaacgtcgtcgtatcgcctgcgaacttcgccaccggggccgccaagaaacccaacgccagcgccgcagcaatcgccgcacgcgcacccgtagcccacgccccagccgtacgtcccctcatcatcttgacgaccacgcccacaccggcgcacgtcgtcagcaacgtcaacaccgttccaccccagctgtccgctcccagcggggccaaaaccttgtcgtggatatcgttctgcaaccccaccagcgggccggtaatccacccgacccagctcatcgccacggtccagtccaacaaccggcacagcaacgcaatgaccatcaggtacgtgttccaacacataccaataatggaggcccacatagccttcaacggggccgtaacgccaccatcgtccatcgacatctggtactgaaacaagtgaataccgttggagtcagtcacattgaaaccgtcacccatccagcccagccccgggcccgacgccatagcaggcacactgctcagcgccaccaccaaaaccagcgtggtgacgatgatacggaaccaccgctccccggccccggggcggcgtggatgacggctcacgctgtctcccggtcgtgctcgggcgggttggagctggcggcttcgcggtggggagcgtaggcaggtctcagtagtcgaatttcaccgacgttgccgtgctgatcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccagtaatgagccaggcgttggctcggcgggattcgcgcacgtactcatcgatggcgtgggaggcttccggcgaggacgacatatggtggaactcgtcaacgatgaaagcggcgtcgcgggcccggtcgctgaagcacaccaggcgagccagacgggcaataagcgcgtagagggctcggccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcaacattgtcgagctgatcgacggtttggcggatggcccgctgatttttctgcatcgcagcgtgacgggtccgggccactccccggatcgccacgtcgaccggcacgccagtgtcgtcgatacggcccaagaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcgacttcggtgattttgttgagggcggcggtccaggcggtgtgggtgcgtattttctggtcttggttgagtttgatcgataggaaccacacgcgccggcctagggatgcggtttcaggctggtcgagggtggcgtcgatttcgtcggcccacacggggtgttcgctcaggtcgaggccggcggccatggcgtcgacgatttctgtggggtcggtccaggtgagggccccgttgaggcagaactcgtggcgggcgaggtggcggaataggtcgcggtgagctgcggcgacggtgagggaggcgttctcggtgacgggtcgctggaggggagtaagtcgccaagtggcccagatgtcgccggtggaggtccagacgaggttgtcgaagaggaaccgttcggggatggacatcatgactccttttcggcggcggcgaggaaggcttccaggccgctgcggcgtacagcgttcccagtagggtgcaggggttttctgggggtgggttcagatttcgaatgtgggaagagtttgtggatggtatcggtgtcctcggcgagggcttggtcgagcaggcaggtggccggggtgtcggtcatctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgacagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacaccgccgacagcgagcacctgatagatcgtgtagggcccgccaggaatccttcgacctgaggaatccttgccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggcggcaacctcccagcgtcctgcacgactgacaagagtcaggccgtactggctagtccgggtagtggattcgtcaccggtgggctggcatgtcacggtcaccgtgacggtaatcttctgccgatctgagggggtggggacctcgtcaggccccaccacatgagtggttttcaccgatacacacggggctgggtcaaccgcggtgaaagcggtccccgggctactccatctcgacaggtcagtattcccggtcagcatggcggccaagaaacccgaagaggtctgggcagccgggtcagcaggacgaatctccgaggagtccacgtcgggggctgaggccggtgcaggcatggggatctgcccaggtagacgcaaggcgatggccttgccgccggcatcgacgtggaccggaaccgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgcatgggcctcgtaggagtagctcttaggtaggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatcggtgcatcgatatacctatgtatctgtctgtggtttttagaggccactcccgtcgccccgggccgctcagcgataccgcaaggctgtgtgggatcagct

SEQ ID NO: 205 - DNA, 2061 bp, Propionibacterium acnes
gcgagccacgaccatcgccaagctgaatggagagcgagcatgagcaccacccctgccgggttcgacttcgacgctctggccgagtgggccgagagcgatgaggcgacccacaccccgcaaaccagccctgtgttccggggcaaggacgccgcgcgcgccagccgcgcattcctcggccgaggacggcccaccctcggcgcggaccacgccaccggtgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgcccccctcttctgggtggtggtccggggcgtcaccgccccggaccagttgggtagtcatctcagttgaaataagcgattagtgatacgcccctcctgctttccggtgctgtcatgagcgtctgacaacagcgacacctcggggcagccgacggacagtcctctggctgccgctctgatcccatgcccacggcacgaaggtgtcggacagctcggtctcatcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgacccgcctggtcctctagccacgacaacgcatcccgaaacagcccgacgtcttccaaagctaaaccacagtcgtagccgcccttatcccccaaccgcaccatctggagctcccggtggcctccctcgtcgacctcgatccacagtttcgcgtgcatccgctggcctcggccctctgacaggatctcggtgagcagatcggacgcctgccctcgcgcatcctcgttactgcgggggaattggagtatgtgggaggaacgatgatgggggaggttggtgacctcatggcgcagcaggttgcgcttgtgcatctgctggtcgagacggtcgggctgacctgttgacggggttgtgccgtggcggcgtttcctcggcggggtctcgatccgttgctcttccggcggttcggcgtcaggttgtggtgcgcgatctcccctaggacgggggggctcgccacctatatccgagggacgatgagacggccttccacgcttgctgcgcactttcgcagcccgccccttgcggtcacgtcgacgcggcggcggagtgacgtcctcaccgcgcgctaactgtgttaacgcctcgaccaggttggtgcccggtttcagcccttttagcacgaaccgcaccaggcgggggtctcggccgattcgtcgggcaatctcggcttggctccacccttcggctaacagggtgcgcaacaagtcttgggcccggttatcacgctcagtcactggtcgcctcctcggggagtcctgcctgctcggcctgctctgatagagcagcccgttccgatccggtctgaggcgctttcaggggaccgggtaggacacctttgacacgcagtcgcccgtccttgccgtcatcgccgcccccctgggccacagggagcgcccaggggggcacgttgctggtgtagatggcgtcgccgtggatagccagcagggtgcgggagttcatgcgtagtgctcctcccttggttgtggcgttttttccggtggtggggtcggcgatgggtgtgttgagggtgcgtacgcgggacagggcccagat

SEQ ID NO: 206 - DNA, 12531 bp, Propionibacterium acnes
ccccaatgcccccacaacgatcagcacacccacggcgatcatcaggtgggcagcactaactgatcccaacggaccaagatcaaacaagccctgcccgggagcgccgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggttctgtgggaaaaatgcttcccattggtccgtcttagttaggaaacttggcctaagtgctgtcgagggtcgcgtgttcgtgaccggttcgaagacactgccgccttgccttcttgtcagtggcgtttccgagatggggtcagtgggcgatggctaggccgatgagggcgccgctgcacaggctgggtgcccaggggaggaatcgggtggtgtggtgtcggaaccggtcgatgagggcatatagggcgatcagggtgaggccggctatgacagtgacctggatcgtgtcgatgccggttgctgcggccggggctgcccacagtggtgtgatgcgcacgtcggagaagccgaagccgcctcgggagatgagccaggcgatcatccacgctgcgaagatgatggcggtagcgatgacagcacgtgttgccgcagtatggtccgagagggcggtaacgactacagccccgatccatccggcccatccggtccacgctaggactgccggtatccatgtggtgatggcgtcaatgacggcaacccatgccccgatggtggctagcagggcccacgtcggccacgtgggtgctggggcccatgctgtggcggtgatcatggtgagtgctgctgcgctacagaccgcgatcaagcttcggaggctgtaggtgtcgcggtaggcgatcttgtcggggctggcggtgggtggttcgggcaggatgtgggtgagggcaggccaccctgcgaccgcaatagccgcgacggcgaccacccacacaatctgttgcatgggtctcatcatggcccatcaacgatgagtatgggtggccgacatgggctcagtcgtcaagaggtgtacgggcggttgtggcttcttgggtgctgagcatgagggtgccagaatcctcgccagccgattcccagtcgacgatgacctggtcgccgtcaacgctggattcggcgatggtcacccattgcccgtccatgtcgatgagcatcccggcggccagctctgtggcggcaaccgggtgggctgggctgtagaagcggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggattcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccaggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgggtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgtcggccagcgatgatgccgtggcgcaccgccccggtagccgcatagaccgcgcacaactcaaacacggggcacccatcgcaggccgccgggtccatgctttctttgtcccacgatggtgggtcatcggtgcacggcacggccaggccgtcctgctgggcggtggcgatagcggtgaataagcgcagctgggcgcgaacttggtctggggtcaggttgacagtgcgggctacacgcatggggttccttcctcttcaccagtgaaggttccttagccccgagcgatgtgcggagagatttcagtgttttatcgaggtgaccagccatccggtctgcgctgcgggttcaggtaccagggtcagatgcaccacggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctgaccatttggcctccaccgatgtagacggccacgtggtgggcaggggtcccccaaaagatgaggtcgccgactttgagctggtcgtgggccacggcagtgccgactttctgctggtcggcggcggttcggggaaggctgatgccgatacgccggtacagcgccgaggtcaggcctgagcagtcgtagccgccatcagctttgccgttaccaccccacacgtaggcgtaggagttgttgtcggcgatcgatttggcccatgccacggcttcggccaggttcttcgacacaccggtctcgttagcggccccgatggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtggcccgtcgttgccctcaccggtgcatccttgccctggcgggtctgcttcgcgatcgccgacatgccgcctcgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccgatccggtgagcttgcgaccaccactgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacataaacgccgaccacaccaacttgcacacgtagaaccagcacatgcccgcgaacaccagcaggaccacagccaaacccgccaccgtcgacgagtaaaagaagaaacccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactagtaatcatccgagacagcgccacaccgaactgctgggtgcgagccaacggagtagccaacgtcgtcgtatcgcctgcgaacttcgccaccggggccgccaagaaacccaacgccagcgccgcagcaatcgccgcacgcgcacccgtagcccacgccccagccgtacgtcccctcatcatcttgacgaccacgcccacaccggcgcacgtcgtcagcaacgtcaacaccgttccaccccagctgtccgctcccagcggggccaaaaccttgtcgtggatgtcgttctgcaaccccaccagcgggccggtaatccacccgacccagctcatcgccacggtccagtccaacaaccggcacaacagggcaacgaccatcaggtacgtgttccaacacatgccaataatggaggcccacatactcttcagcggggccgtaacgccaccatcgtccatcgacatctggtactgaaacaagtgaataccgttggagtcagtcacattgaaaccgtcacccatccagcccagcccaggacccgacgccatggcaggcacactgctcagcgccaccaccagaaccagcgtggtgacgatgatacgaaatcgccgctccccggccccggggcggcgtggatgacggctcacgctgtctcccggtcgtgctcgggcgggttggagctggcggcttcgcggtggggaccgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcgttggctcggcgggattcgcgcacgtactcgtcaatggcgtgggaggcttccggcgaggacgacatatggtggaactcgtcaacgatgaaagcggcgtcgcgggcccggtcgctgaagcacaccaggcgagccagacgggcaataagcgcgtagagggctcggccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcaacattgtcgagctgatcgacggtttggcggatggcccgctgatttttctgcatcgcagcgtgacgggtccgggccactccccggatcgccacgtcgaccggcacgccagtgtcgtcgatacggcccaggaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggatgcggtttcaggctggtcgagggtggcgtcgatttcgtcggcccacacggggtgttcgctcaggtcgaggccggcggccatggcgtcgacgatttctgtggggtcggtccaggtgagggccccgttgaggcagaactcgtggcgggcgaggtggcggaataggtcgcggtgagctgcggcgacggtgagggaggcgttctcggtgacgggtcgctggaggggagtaagtcgccaagtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaagagtttgtggatggtatcggtgtcctcggcgagggcttggtcgagcaggcaggtggccggggtgtcggtcatctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgacagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttgccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggcggcaacctcccagcggcctgcacgactgacaagagtcaggccgtactggctagtccgggtagtggattcgtcaccggtgggctggcatgtcacggtcaccgtgacggtaatcttctgccgatctgagggggtggggacctcgtcaggccccaccacatgagtggttttcaccgatacacacggggctgggtcaaccgcggtgaaagcggtccccgggctactccatctcgacaggtcagtattcccggtcagcatggcggccaagaaacccgaagaggtctgggcagccgggtcagcaggacgaatctccgaggagtccacgtcgggggctgaggccggtgcaggcatggggatctgcccaggtagacgcaaggcgatggccttgccgccggcatcgacgtggaccggaaccgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgcatgggcctcgtaggagtagctcttaggtaggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgccccggagatagatcgatgtctatgcatcggtgcatcgatatacctatgtatctgtctgtggtttttagaggccactcccgtcgccccgggccgctcagcgataccgcaaggctgtgtgggatcag

SEQ ID NO: 207 - DNA, 12036 bp, Propionibacterium acnes
ccccaatgcccccacaacgatcagcacaccaacagcgatcatcaggtgggcagcactaactgatcccaacgaaccaagatcaaacaagccctgcccgggagcgtcgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacagcagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgctttgccttcttgtcagtggcgtttccgagatggggtcagtgggcgatggctaggccgatgagggcgccgctgcacaggctgggtgcccaggggaggaatcgggtggtgtggtgtcggaaccggtcgattagggcatatagggcgatcagggtgaggccggctatgaccgtggcgtggatcgtgtcgatgccggttgctgcggccggggctgcccacagtggtgtgatgcgcacgtcggagaagccgaagccgcctcgggagatgagccaggcgatcatccacgctgcgaagatgatggcggtagcgatgacagcacgtatcgccgcagtatggtccgagagggcggtaacgactacagccccgatccatccggcccatccggtccacgctaggactgccggtatccatgtggtgatggcgtcaatgacggcaacccatgccccgatggtggctagcagggcccacgtcggccacgtgggtgctggggcccatgctgtggcggcgatcatggtgaccgcagccgcggcacagaccgcgatcaagcttcggagactgtaggtgtcgcggtaggcgatcttgtcgggattggcggtggccggttcgggcaggatgcgagtgagggagggccatcctgcggtcgcaatagccgcgacggcgaccacccacacgatctgttgcatgggtctcatcatggcccatcatcgatgagtatgggtggccgacatggggtcactcgtagaggggatcgaggggtgtgcgggcgagcatggcttcctgtgtgccgagcatgagggtgccagagtcgtcgccggccgattcccagtcgacgatgatctgcccgctgtcgacgctggattcggtgatggtcacccattctccgtcgatattgatgagcaccccagcggccagctctgtggcagcaaccgggtgaggtgggttgtagaagcggtcgatgtcgcaggcagggtcgtcgggttcctcgactaccggaggtggggtagggctgagctgttcggtgtcgtcggccaggtcggctcccaggatgcgctcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgcctcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggagtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccaccgcggtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcagcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtactggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagccaactggccgatcaccgagcccctttcggaacgcttgctgcgcatccaatcgttgatcttgtccctcagccccttctcgcccttgtgacgacgccacatggatatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaacccaccaaccacgaaccatccgcaatatcgccggcgtaatccgacagcccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatccgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcagcaccgttccaccccagctgtccgctcccagcggggccaaaaccttgtcgtggatgtcgttctgtaaccccaccagcgggccggtaatccacccgacccagctcatcgccacggtccagtccaacaaccggcacagcaacgcaatgaccatcaggtacgtgttccaacacatgccaataatggaggcccacacacccttcagcggggccgtaacgccaccatcgtccatcgacatctggtactgaaacaagtgaataccgttggagtcagtcacattgaaaccgtcacccatccagcccagccccgggcccgacgccatagcaggcacactgctcagcgccaccaccaaaaccagcgtggtgacgatgatacgaaatcgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgctggtcggcgtacaggccacaaccgggacctccggggttgagggcaatcttgaccaggtcagcgaactcttcaggggacgtcttgggatctacgcccaggaactcaacgcccttttgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaataagcgcgtagagggctcggccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagtgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgatgcctgggtcatctcaccgccctcgacgttgtcgagctggtcgacggtttggcggatggcccgctgatttttctgcatcgcagcgtgacgggtccgggccactccccggatcgccacgtcgaccggcacgccagtgtcgtcgatacggcccaggaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcagcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaagtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcaggtttcgggtctaggaggggtttgggctcgtaggtggtgtcgatgtcttcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacgcgccaccagcccgccagccatgccagaggtgaccaggtccagtcgatgcggccgatgatgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccgtccggaggcagaaggcgtgacggctggtcgagggaggcaacctcccagcggcctgcacgactgacaagagtcaggccgtactggctggtccgggtggtggattcgtcgccggtgggctggcatgtcacggtcgcggtgacagcgatcttctgccggtctgagggggtggggatctcgtcaggccccaccacatgagtggttttcactgatacgcatggggctgggtcaaccgcggtgaaagcggtccctgggctactccatctcgacaggtcgtcgctgccactcagcatggcggttaggaagcctgaagaggcttgggcggccgggtcggcggtgcgaagctccgaggtgtctagggtgggggctgaggccggtgcaggcatggggatctgtccaggtagacgcaaggcgatggccttgccgttggaatcgacgtggaccgggactgaccaggcctgtccggtcccggattggccgcccatggtgatcactgtgacctgccacaggctcggatcagacggggagacggtagcgtcataggcggtgacggtggtgggcgctggaccaggtttgcggggcatgcgcgcatcggtgatcttggccgccaccaggtgctccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacaacacgagggcaaggaagcctttggtggccatcgatccggtgtggggccagggacccacgttttcctgtgcctgttttttcttggccgaccaacggcggggcttgggctcagcggatgcactttctgagttacgtactcgtcccaatcgcatcggtcacctccttcactggatgaagggaccaaggaggtgaccgatgtgcggtcga

SEQ ID NO: 208 - DNA, 9744 bp, Propionibacterium acnes
gctgacatgcaccgcccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatcggtgcatcgatatacctatgtatctgtctgtggtttttagaggccactcccgtcgccccgggccgctcagcgataccgcaaggctgtgtgggatcagctgcgccgctcccccgacatggcagacagcaccctgcggactgactgacactgtggcgccgcggaggtctcccgcggcgtccgctggggcgagtgcatgcctgtcagctcatcttttatcgtcatgtttccccttgtcagagcgggctttgcaaagtgacaacgttggggggcttgacgacaacgtcctcgacaaccccgaggcggtgatctgtgtcttgtcagatcaaccgcaacgggaaagaggcaccgctgatgttcgccaccacagctaccctcaacgatgaatgggaccagattcgcgccactgagatcgattggcatgactgccccgaactgatgcactgcgtcaccgccgaggatgtgctggccgtcatcccggccgcccccgacgccatcttgggctacctcattacccgagctcaggacggtgacgaattagccacccgcaccatcatccaagcgttcacaggcaagcttattttgatggccacggccaccaaggtgcgccgtactaatgacggcttcaatgatctgctggcggggttgtgggagacgatcatcacgtacccgttggatcgtcgccctgacaagatcgctgcgaacctcaccctcgacacgttgcaccgggttacccggttctggcgtgctgattcccccgatgaggaagacgctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcgtatcttctagcaattgatctagctatgtatatagctgatgatctagctatcatatagctgtgtctccagcccaaatgacagcccaatggcatgcttgccacaggaaggtgcgtcagcctcccgaaatactggaaggagctttagcgtgcaggacatgaccagtcctattgaccgatccccgttcgaccgcactattgcggtgtggaaccacaaaggcggcacgttcaagacgtccgtcgtggcgaacctgggatacctgttcgccgccggtggcaacaaggtgttgatggtcgacatggacccccaggccaatctcgacatcgacttcggtatacccgcaggagaacgtgaacggggcatgggattagccgaggcgctacgtgaggggactgtccttcccccaccacagcatctcagcgaaaacctccacctggtcagtggcggcgctgctctcaacgagttcaccgaccccgcatccttagcggccatcatcgaccgagtcaccaccgagcgctacgacctgctagctcaggcccttgccccgctggcctgggactatgacctcatcttcatcgactccgggcctgcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaagcccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaagaatggcttggaccagctgacccggacgagtggggcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcatcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccgctcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcggcgtcgtcggggtgggccagctctcagcaggtgtcccaagctcaaccggtgatgacccgttcggagaacgtggattggccggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcagcggaagtgtcattgcaaccgtcggtggtcatccgccaacatttgctcacccaaatcagtctgggggatctgtcacatcgcggaatgatgccggtggaagtggcccggttcctcgatgaggcggtacaagctggcaagtccatcgtggtcgccggtgagcagggtgcaggcaagacgacgtttttacgagcgttgatccacgccattccgatgcgggagcggttcgccacgctggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcctcggccatgttccaggccatgcagtcgggtacaggcaccatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggccgatgcgtggaccggtcagccgttgaccccgctcatgcctggttcggccgccgacgagctgtctcacttcgcccgagacctggattactgcgaggcccactcatgaacactcccgcactaaccagcgccctcatcatggccgggctagggctgatcctggccatcgacgggctggtcccggcgccgcctcgacctggggccccgctgagcccggcccagaggtgggccaggctcacccaccgtcccacaggagcggccgggcgccgccgggatttgcgttgggggttggctgttctcgtcggcgtcgtgctgtttgtgctcaccgggtgggtggctgcgctggcgttgggccccatcattgtgttgttggcccccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcacccgcggggagcctcgacaacgttgaaagctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggttaggaggacccgatgaccattactgctttgtccctgctggtcggggccatcgtcactgtcggactgctggtcatcgtggcagcgttccgcccagccccaggccctgacctgtttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccacgatcacccagcggcttggcctgtggacgatcctgcaagccggctcggtcatgctcatcttgctgggggcggccgccctcacactaatcacagccggataaaacgacaccgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaagctcagcgtgtcgtccatccggtcccggggtcggcacaggaggcagcctcgcagatcactagtcatggcggggtgcgtgatacccggatatcggtcagtgatgacggggccactgtcacggtgaccgtggtgggccgggccccatcgatgctggggctgcatcttcctgctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgagtggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggccggcacccaggacagccccgccaccacctctcaggccccggacgcctccaccactccgaaaatctggaagacctacacggtgcgggccaacgactacctgtggaagatcgccgagcactactacggtgacg

SEQ ID NO: 209 - DNA, 1127 bp, Propionibacterium acnes
accccaactcgcctcaccacacgtcgacctcgacaccgatcaagcgacccgtatcagcgacattgccgtaccgctgacccgcctggtcctctagccacgacaacgcatcccggaacatccgcacgtcttccaaagcgaaaccgcagtcgtagccgcccttgtcccccaaccgcacaatctggcgctcccggtggcctccctcgtcgacttcgatccatagtttcgcgtgcatccgctggccgcggccttctgacaggatctcggtgagcagatcggaggcttgtcctcgcgcatcctcgttgtcgcgagggaattggagtgtgtgggaggaacgacgatgggggaggttggtgacctcgtgacgcagcaggttgcgcttgtgcatctgccgttcgagacgctcgggctgacctgttgacggggttgagccgtggcgccgcttcctcggcggggtctcgatccgttgctcttccggcggttcggcgtcaggttgtggtgcgcgatctcccctaagacgggggggctcgccacctatatccgagggacgatgagacggccttccacgcttgctgcgcactttcgcagcccgccccttgcggtcacatcgacgcggcggcggagtgacgtcctcaccgcgcgctagctgcgtcaacgccgacaccaggttggtgcccggtttcagcccttttagcacgaaccgcaccaggcgggggtctcggccgattcgtcgggcaatctcggcttggctccacccttcggctaacagggtgcgcaacaagtcttgggctcggttatcacgctcagtcactggtcgcctcctcggggagtcctgcctgctcggcctgctctgatagagcagcccgttccgatccggtctggggcgcttccaaagggcccggcaagacacctttgacacgcagccgcccgtccttgccgtcatcgccgcccccctgggccacagggagcgcccaggggggcacgttgctggtgtagatggcgtcgccgtggatagccagcacggtgcgggagttcatgcgtagtgctcctcccttggttgtggcgttttttccggtggtggggtcggcgatgggtgtgttgagggtgcgtacgcgggacagggcccagat

SEQ ID NO: 210 - DNA, 718 bp, Propionibacterium acnes
ccggggccctgctgctggtgtgggacgtcaccgttttgaccgggcccactctcggccaccgcgtgcgtcctctcagtaaggacgccgagctgactgcccggcgctggctcgaccaggtcgccgacaaccccggcttcctcgacacccttatcgaggccgcccgcatcaccgagggatggcatcacgcgacgcctccgcacattcaggccccttaccggacccttcatcagtgaacggaggtacaacgacatgaccagcgacattgacattgaccggacccacaaacccgacgaccgcgccgaggctcctctttaccgagcctgggccaggagactcgtgcacgtctccgggatgccctggcgtatcgtcgccgccttggccggggtctcccccacctccatgcaccggcttctattcggccgcaacggtcgacccgtggaatggatcggcatcaatgatgctcgcgccctgatggatatcggcatcgatgatctcgcctcagcgtccaccgaccgtatcccggcccgcgaatcccgcgagctgttggtagccctgcacaccctcggctggaccgatgagcatctaagccgctggctgaccagttccgacctcgacctggccaccacccccaaggccctctacgtcacccggctatccgccgcccgcatccaggccacctacgacatgctcatcagccagcccgtccgccgctgcggcc

SEQ ID NO: 211 - DNA, 11765 bp, Propionibacterium acnes
ggtcagtgggcgatggccaggccgacgagggcgccgctgcacaggctgggtgcccagggaaggaatcgggcggtgtggtatcggaaccgatcgattagggcatatagggcgatcagggtaagcccggctatgacagtgacctggatcgtgtcgatgccggttgctgcggccggcgctgcccacagtggtgtgatacgcacgtcggagaagccgaagccgcctcgagagatgacccaggcgatcatccacgctgcgaagatgatggtggtagcgatgacagcacgtgttgccgcagtctggtccgagagggcggtaacgactacagccccgatccatccggcccatccggtccacgctagggctgccggtatccatgtggtgatggcgtcaatgacggcaacccatgccccgatggtggctagcagggcccacgtcggccatgtgggtgctggggcccatgctgtggcggtgatcatggtgagtgctgctgcggtacagaccgcgatcaagcttcgggggctgtaggtgtcgcggtaggcgatcttgtcgggattggcggtagctggttcgggcaggatgcgagtgagggcaggccatcctgcggccgcaatagccacgacggcgaccacccacacgatctgttgcatgggtctcatcatggcccatcatcgatgggtgtgggtggccgacatggggtcactcgtcgaggaggtcgaggggtgtgcgggcaagcatggcttcctgtgtgccgagcatgagggtgccagagtcgtcgccggccgattcccagtcgacgatgacctggtcgccgtcaacgctggattcggcgatggtcacccattgcccgtccatgtcgatgagcatcccggcggccagctctgtggcggcaaccgggcggggtgggctgtagaggaggtcgatgtcgcgggcaaggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgcctcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgcgccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggagatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagctccccgtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacagcagtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagggtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtactggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctgacgggcctgcttcgcgatcatcgacataccgccccgcaacgccgaaacacggttgtgagcgtgggcgacggccgacataccagctgtcgtaattttcgactggccctgcggagctcctcccccggtacggatctgacgatatgacgccgaagcacgccgcgccgccgaggccattcgcgccatcttcgcagcccgggtcactcccaccgacgcgccaccggtgactaccgcagccgcagccgaaaccatccgccttcgacccaatccagtgagcttgcgaccaccgctgcgcaccatccggcgagcaccccgcccagcccactggccaatcgccgacgccccttcagagcgcttactacgcatccagtcgttgatcttggccctcagcccctcctcacccttgtgactacgccacagagacaccaagaatccgatgattcccacgatttccaacatgttgacgaccatgaccttgatgacaacgttgccatcagaggcgaagaccgacttgatgacgagcatgaccacgcccaacatcaccatcgacccaacaatgccgatcatcgagtacaagatcgaacacagatcccggataagcgggtctgtgcgaccaggaatagcccgcaacacgttgagcatcgacatgaacgccgaccacaccaacttgcacacgtagaaccagcacatgcccgcgaacaccagcaggattgctgccaaacccgccaccgtcgacgagtaaaagaagaaccccaccaaccaggaaccgtccgcaatatcgccggcgtaatccgacaacccctcgtcacaatcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggagccttcgagtctcccgtcgaggtcatgtcatcaggaacctcaacctcaccagcggtcgccgtcccaggatcaaccgaactagtaatcatccgagacagcgccacaccgaactgctgggtgcgagccaacggagtagccaacgtcgtcgtatcacctgcaaaattcgccaccggggccgccaagaaacccaacgccagcgccgcagcaatcgccgcacgcgcacccgtagcccacgccccagccgtacgtcccctcatcatcttgacgaccacgcccacaccggcgcacgtcgtcagcaacgtcaacaccgttccaccccagctgtccgctcccagcggggccaaaaccttgtcgtggatgtcgttctgcaaccccaccagcggtccggtaatccacccgacccagctcatcgccacggtccagtccaacaaccggcacaacagggcaacgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagcccaggacccgacgccatggcaggcacactgctcagcgccaccaccagaaccagcgtggtgacgatgatacggaaccgccgctccccggccccggggcggcgtggatgacggctcacgctgtctcccggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgagggggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctctttcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcggtattcccggtcagcatggcggttaggaagcctgaagaggcttgggcggccgggtcggcggtgcgaagctccgaggtgtctagggtgggggctgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatcggtgcatcgatatacctatgtatctgtctgtggtttttagaggccactcccgtcgccccgggccgctcagcgataccgcaaggctgtgtgggatcagct

SEQ ID NO: 212 - DNA, 2055 bp, Propionibacterium acnes
gcgagccacgaccatcgccaagctgaatggagagcgagcatgagcaccacccctgccgggttcgacttcgacgctctggccgagtgggccgagagcgatgaggcgacccacaccccgcaaaccagccccgtgttccggggcaaggacgccgcgcgcgccagccgcgcattcctcggccgaggacggcccaccctaggcgcggaccacgccaccggcgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcatgctttccggtgctgtcatgagcgtctgacaacagcgacacctcggggcagccgacggacagtcctctggctgccgctctgatcccatgcccacggcacgaaggtgtcggacagctcggtctcgtcatgtgcccaaatagcgtcgtgggcctgtcgccaagcttctcgggagccccacacgggcacgaccgggccacaccggtgtcctggcctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgccccgcctggtcctccagccacgacaacgcatcccgaaacagcccgacgtcttccaaagctaaaccacagtcgtagccgcccttgtcccccaaccgcacaatctggcgctcccggtggcctccctcgtcgacctcgatccacagtttcgcgtgcatccgctggcctcggccctctgacaggatctcggtgagcaggtcggacgcctgccctcgcgcatcttcgttactgcgggggaattggagtatgtgggaggaacgatgatgggggaggttggtgacctcatggcgcagcaggttgcgcttgtgcatctgctggtcgagacggtcgggctgacctgttgacggggttgagccgtggcgccgcttcctcggcggggtctcgatccgttgctcttccggcggttcggcgtcaggttgtggtgcgcgatctcccctaggacgggggggctcgccacctatatccgagggacgatgagacggccttccacgcttgctgcgcactttcgcagcccgccccttgcggtcacgtcgacgcggcggcggagtgaggtcctcaccgcgcgctagctgcgtcaacgccgccaccaggttggtgcccggtttcagccctttcagcacgtagcgcagcaggcgggggtctcgcttgattcgtcgagcgatctcattctggctccacccctcggccaccagggtgcgcagcagatcctgggcccggctgtcacgctcagccacggctcaccccctcagggatgcctgcctgctcggcctgctctgacagggctgctcgttccgatccggtctgcggcgcttccagagggccaggcaagacacccttgacacgcagccgaccatccttgccatcgtcgccgcccccctgggccacagagagcgcccaggtaggcacgctgctggtgtagatggcgtcgccgtgaatggccagcagacagcgagttctcaacgctcctcccctggttgtggcgtttttcccggtggcggggtcagcgatgggtgtgttgagggtgcgcacgcgcgacagagcccagata

SEQ ID NO: 213 - DNA, 11284 bp, Propionibacterium acnes
gtccacgctagggctgccggtatccatgtggtgatggcgtcaatgacggcaacccatgccccgatggtggctagcagggcccacgtcggccacgtgggtgctggggcccacattgtggcggcgatcatggtgaccgcagccgcggcacagaccgcgatcaagcttcggagactgtaggtgtcgcggtaggcgattttgtcgggggtggcggtggccggttcgggcaggatgcgagtgagggagggccatcctgcggtcgcaatggtcacgacggcggcgatccacacgatctggtgcatgggtctcatcatggcccaatatcgatgggtgtgggtggccgacatgggctcagtcgtcgagaggtttgcgggcggttgtggcttcttgggtgccgaggatgagggtgccggagtcgtcgccggctgattcccagtcgacgatgacctggtcgccgtcaacgctggattcggcgatggtcacccattgcccgtccatgtcgatgagcatcccggcggccaggtctgtgacggcaaccgggtggggtgggctgtagaggaggtcgatgtcgcgggcagggtcgtcgggttcttcggttacctcgggtggggtcgatctggctgtctcggtgtcgtcggccaggtccgctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgcctcggccgcgtttgccgaacgggatgcccacgccgatgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcttcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtggggcgttgaggagggccatacgcgcggtagcgctggcgacatcgagcgggtcggagtggggtcaggtgtagggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccaccgcggtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctttcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccaatcgccgacgccccttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacagatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgaggggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcattgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcagtattcccggtcagcatggcggttaggaagcctgaagaggcttgggcggccgggtcggcggtgcgaagctccgaggtgtctaaggtgggggccgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggggggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctgga

SEQ ID NO: 214 - DNA, 9776 bp, Propionibacterium acnes
tgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaattgatctagctatgtatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggttggggctgatcctggccatcgacgggctggtcccggcgccgcctcgacctggtgccccgctgagcccggcccagaggtgggctcggctcacccaccgtcccacaggagcggccgggcgtcgccgggatttgcgttgggggttggctgttctcgtcggcgtcgtgctgtttgtgctcaccgggtgggtggctgcgctggcgttgggccccatcattgtgttgttggcccccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgaatggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccgggggggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgtcaccacctctcaggccccggacgcctccaccactccgaaaatctggaagacctacacggtgcgggccaacgactacctgtggaagatcgccgagcactactacggtgacggcgcccaattccgtcgtatcgccgaagcctccggtatcgacccgcactcagagctgaaagtcggccagaaactgatcctgccggttcccgagaacacggccgcagttcattcggttaaagcgggggagtatctgtgggagatcgccgagcactactacggtgacggcgcccagtaccataaaatcgctgaagcttccggtatcgatgcccattccgatctagccgtgggccaaaaactcgtcatccccgggcccctccgccacgacgccacgccgccacaccactcggcgtcgacccacgcgaag

SEQ ID NO: 215 - DNA, 2238 bp, Propionibacterium acnes
gacgccggccaccccaactactccgacccacacggtgaccccagctccggcctctgccggccactcgaccagcgacgagcacccactccatacggataccgccgcagcggacaaggccagcaacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccaggttcgcgtcgacaccgaccaacccggcaccgacacccccttccccatcgacgacatcgacccgctgagctccgaccacccggtcctatccatcatcggccaccccgacatcacaggtgccactggaaccgttgggcgctccccgtggcgctgccaacagttggccctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgttgatgcggctcttcaggtgacggatcgggctctggaagccggggacttggggctggcccggtgggcgttgacccaagggctactggtgtctcccgatcatgaggacctggtcgccggttgtctgcgcaccgagtaccaggccggcaacatggacaaggtttccgagctggtcgatcacctgtcggctaccgcacgacgcctgggcgtcgatttgagcgccgacaccacccggatcatcgatacggtcacccacgccgacaggagagcgtcatgatctcccctgcactcatctccgtcaggaaggttcctatgcaccat

SEQ ID NO: 216 - DNA, 10907 bp, Propionibacterium acnes
ggcttcctgtgcgccgagcatgagggtgccagaatcctcgccagccgattcccagtcgacgatgacctggtcgccgtcaacgctggattcggcgatggtcacccattgcccgtccatgtcgatgagcatcccggcggccagctctgtggcggcaaccgggtgggctgggctgtagaggaggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgacaagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccaccgcggtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctttcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccaatcgccgacgccccttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccggacccgatgccatggcaggcacactgctcagcgccaccaccagaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacagatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaggggtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcattgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcagtattcccggtcagcatggcggttaggaagcctgaagaggcttgggcggccgggtcggcggtgcgaagctccgaggtgtctagggtgggggccgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctgga

SEQ ID NO: 217 - DNA, 9469 bp, Propionibacterium acnes
tgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaattgatctagctatgtatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggttggggctgatcctggccatcgacgggctggtcccggcgccgcctcgacctggtgccccgctgagcccggcccagaggtgggctcggctcacccaccgtcccacaggagcggccgggcgtcgccgggatttgcgttgggggttggctgttctcgtcggcgtcgtgctgtttgtgctcaccgggtgggtggctgcgctggcgttgggccccatcattgtgttgttggcccccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgaatggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtga

SEQ ID NO: 218 - DNA, 2098 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggtttttgtctgcccagcgtttctcggcgatgtcgatcatgtcttggatggttttgacccatcctcggatgggatcgactttggtcagtttgatcccttcgaggaactcgatgggctgggtgatgggcccatccggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggtcagttctcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcggtagctgggcatgtcaccctcccctatctgtcaaatgagctagacacagtgtctatttaatttgacgcaaagtcaagtgtgctagacgcctttgtgtggatccgcccgcccagacaggcactcacgtctcatgacccgccgcgacgtcttaacgaaaccaaaccgcttatagaaccgctccgcagcgggcccggagggcttcagttcgagggtgagaccttgctggtcggcccattggcagacttgtgtgaggatctgtgagccgt

SEQ ID NO: 219 - DNA, 1726 bp, Propionibacterium acnes
cctcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcctgctttccggtgctgtcatgagcgtctgacaacagcgacacctcggggcagccgacggacagtcctctggctgccgctctgatcccatgcccacggcacgaaggtgtcggacagctcggtctcgtcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgactagccgacccctatcggcgacattgccatactgctgacccgcctggtcctctagccacgacaacgcatcccgaaacagcccgacgtcttccaaagctaaaccgcagtcgtagccgcccttgtcccccaaccgcacaatctggcgctcccgacggccaccttcatcgacttcgatccatagtttcgcgtgcatccgctggccgcggccttctgacaggatctcggtgagcagatcggaggctcgcatcctcgttaccgcgagggaattggagtgtgtgggaggaacgacgatgggggaggttggtgacctcgtgacgcagcaggttgcgcttgtgcatctgccgttcgaggcgctcgggctgactcgttgacggggttgtgccgtggcgccgcttcctcggcggggtctcgatccgttgctcttccggcggttcggcgtcaggttgtggtgcgcgatctcccctaggacgggggggctcaccacctatatccgagggacgatgagacggccttccacgcttgctgcgcactttcgcagcccgccccttgcggtcacatcgacgcggcggcggggtaacctcctcgccccgctccaactgtgttaacgccgccaccaggttggtgcccggtttcagcccttttagcacgaaccgcaccaggcgggggtctcggccgattcgtcgggcaatctcggcttggctccacccctcggccaacagggtgcgcaccaagtcttgggcccggttatcacgctcagtcactggtcgccccctcggggagtcctgcctgctcggcctgctctgatagagcagcccgctccgatccggtctgaggcgctttcaggggcccgggcaagacacctttgacacgcagccgcccgtccttgccgtcatcgccgcccccctgggccacagggagcgcccaggggggcacgttgctggtgtagatggcgtcgccgtggatggccagcagggtgcgggagttcatgcgtagtgctcctcccttggttgtggcgttttttccggtggtggggtcggcgatgggtgtgttgagggtgcgtacgcgggacagggcccagat

SEQ ID NO: 220 - DNA, 619 bp, Propionibacterium acnes
ggcggtggctcgaccaggtcgccgacaaccccggcttcctcgacacccttatcgaggccgcccgcatcaccgatggatggcatcacgcgacgcctccgcacattcaggccccttaccggacccttcatcagtgaacggaggtacaacgacatgaccagcgacattgacattgaccggacccacaaacccgacgaccgcgccgaggctcctctttaccggtcctgggccaggagactcgtgcacgtctccgggatgccctggcgtatcgtcgccgccttggccggggtctcccccacctccatgcaccggcttctattcggccgcaacggtcgacccgtggaatggatcggcatcaatgatgctcgcgccctgatggatatcggcatcgatgatctcgcctcagcgtccaccgaccgtatcccggcccgcgaatcccgcgagctgttggtagccctgcacaccctcggctggaccaacgcgcacttgagccgctggctgaccagttccgacctcgacctggccaccacccccaaggccctctacgtcactcgactatccgccgcccgcatccaggccacctacgacatgctcatcagccagcccgtccgccgctgcggcc

SEQ ID NO: 221 - DNA, 8774 bp, Propionibacterium acnes
gaaggttccctagacccggccgatgtgcggagggatttcagtgttttatcgaggtgaccagccagccggtctgcgctgcgggttcaggtaccagggtcagatgcaccacggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacagcagtgccgactttctgctggtcggcggcggtgcggggaaggctaatgccgatacgccggtacagcgccgaggtcaggcctgagcagtcgtagccgccatcggctttgccgttaccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtggcccgtcgttgccctcaccggtgcatccttgccctggcgggtctgcttcgcgatcgccgacatgccgcctcgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccgatccggtgagcttgcgaccaccactgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacataaacgccgaccacaccaacttgcacacgtagaaccagcacatgcccgcgaacaccagcaggaccacagccaaacccgccaccgtcgacgagtaaaagaagaaacccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactagtaatcatccgagacagcgccacaccgaactgctgggtgcgagccaacggagtagccaacgtcgtcgtatcgcctgcgaacttcgccaccggggccgccaagaaacccaacgccagcgccgcagcaatcgccgcacgcgcacccgtagcccacgccccagccgtacgtcccctcatcatcttgacgaccacgcccacaccggcgcacgtcgtcagcaacgtcaacaccgttccaccccagctgtccgctcccagcggggccaaaaccttgtcgtggatatcgttctgcaaccccaccagcgggccggtaatccacccgacccagctcatcgccacggtccagtccaacaaccggcacagcaacgcaatgaccatcaggtacgtgttccaacacataccaataatggaggcccacatagccttcaacggggccgtaacgccaccatcgtccatcgacatctggtactgaaacaagtgaataccgttggagtcagtcacattgaaaccgtcacccatccagcccagccccgggcccgacgccatagcaggcacactgctcagcgccaccaccaaaaccagcgtggtgacgatgatacggaaccaccgctccccggccccggggcggcgtggatgacggctcacgctgtctcccggtcgtgctcgggcgggttggagctggcggcttcgcggtggggagcgtaggcaggtctcagtagtcgaatttcaccgacgttgccgtgctgatcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccagtaatgagccaggcgttggctcggcgggattcgcgcacgtactcatcgatggcgtgggaggcttccggcgaggacgacatatggtggaactcgtcaacgatgaaagcggcgtcgcgggcccggtcgctgaagcacaccaggcgagccagacgggcaataagcgcgtagagggctcggccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcaacattgtcgagctgatcgacggtttggcggatggcccgctgatttttctgcatcgcagcgtgacgggtccgggccactccccggatcgccacgtcgaccggcacgccagtgtcgtcgatacggcccaagaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcgacttcggtgattttgttgagggcggcggtccaggcggtgtgggtgcgtattttctggtcttggttgagtttgatcgataggaaccacacgcgccggcctagggatgcggtttcaggctggtcgagggtggcgtcgatttcgtcggcccacacggggtgttcgctcaggtcgaggccggcggccatggcgtcgacgatttctgtggggtcggtccaggtgagggccccgttgaggcagaactcgtggcgggcgaggtggcggaataggtcgcggtgagctgcggcgacggtgagggaggcgttctcggtgacgggtcgctggaggggagtaagtcgccaagtggcccagatgtcgccggtggaggtccagacgaggttgtcgaagaggaaccgttcggggatggacatcatgactccttttcggcggcggcgaggaaggcttccaggccgctgcggcgtacagcgttcccagtagggtgcaggggttttctgggggtgggttcagatttcgaatgtgggaagagtttgtggatggtatcggtgtcctcggcgagggcttggtcgagcaggcaggtggccggggtgtcggtcatctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgacagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacaccgccgacagcgagcacctgatagatcgtgtagggcccgccaggaatccttcgacctgaggaatccttgccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggcggcaacctcccagcgtcctgcacgactgacaagagtcaggccgtactggctagtccgggtagtggattcgtcaccggtgggctggcatgtcacggtcaccgtgacggtaatcttctgccgatctgagggggtggggacctcgtcaggccccaccacatgagtggttttcaccgatacacacggggctgggtcaaccgcggtgaaagcggtccccgggctactccatctcgacaggtcagtattcccggtcagcatggcggccaagaaacccgaagaggtctgggcagccgggtcagcaggacgaatctccgaggagtccacgtcgggggctgaggccggtgcaggcatggggatctgcccaggtagacgcaaggcgatggccttgccgccggcatcgacgtggaccggaaccgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgcatgggcctcgtaggagtagctcttaggtaggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatcggtgcatcgatatacctatgtatctgtctgtggtttttagaggccactcccgtcgccccgggccgctcagcgataccgcaaggctgtgtgggatcag

SEQ ID NO: 222 - DNA, 8231 bp, Propionibacterium acnes
gggatgaggatgacggccgcgccgacacttcggagcgaggtcatgtgacgatccttcggtagctcgacgggttgccgtagatcttttccacgttgatgccgctgtgggggttgtcggcgctaaccatttggcctccaccgatgtagacggccacgtggtgggcagggcttccccagaggatgaggtcgccgactttgagctggtcacgggccaccgcggtgccgacgtgctgttgttcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacataccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatccgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcccccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccaaaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgtcttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcgtcaatggcgtgggaggcttccggcgaggacgacatgtgatgaaactcgtcaacaatgaaagcggcgtcgcgggcccggtcgctgaagcacaccaggcgagccagacgggcaataagcgcgtagagggctcgaccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcaacattgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcaaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaagagtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgacagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgggctggcatgtcacggtcaccgtgacggtaatcttctgccggtctgagggggtggggacctcgtcaggtcccaccacatgagtggttttcactgatacgcatggggctgggtcaaccgcggtgaaagcggtccctgggctgctccatctcgacaggtcggtattcccggtcagcatggcggttaggaagcctgaagaggcttgggcggccgggtcggcggtgcgaagctccgaggtgtctagggtgggggctgaggccggtgcaggcatggggatctgtccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatctgtgcatcgatatacctatgtatctgtctgtggtttttagaggccactcccgtcgccccgggccgctcagcgataccgcaaggctgtgtgggatcagct

SEQ ID NO: 223 - DNA, 2020 bp, Propionibacterium acnes
ttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgctgcggcctccttgtggcaggtcatttcacaggcatgccggccagcgatgatgccgtggcgcaccgccccggtagccgcatagaccgcgcacaactcaaacacggggcacccatcgcaggccgccggatccatgctctctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcaggaatctggttgggtttcgcggccatcagggagcccatgagggtcggtgcggcgatctggacgagggcgactttgcgggcggcgggatcgcgggtcaaccagccgcgggtgaaagcgagcgccgccgacgtgatatcggggctcagcggggctggagtggcggctgggtgggccgttgaggagggccacacgcgcggtagcg

SEQ ID NO: 224 - DNA, 8643 bp, Propionibacterium acnes
caacgctggattcggcgatggtcacccattctccgtcgatattgatgagcaccccagcggccagctccgtggcagcaaccgggtgaggtgggttgtagaagcggtcgatgtcgcaggcagggtcgtcgggttcctcgactaccggaggtggggtcgatctggctgtctcggtgtcgtcggccaggtcggctcccaggatgcgctcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccacgagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccatccggtctgcgctgcgggttcaggtaccagggtcagatgcagcatggtgtggtcggctaggggcacggcgaccaggggcccgtcggcgctcgccccggtgagggtggggggtccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacagcagtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcataatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctttcgctggtttgagggggcgacgcctgctggtacgcacaggcttggttggtccagtccgccgttggttggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctgacgggcctgcttcgcgatcatcgacataccgccccgcaacgccgaaacacggttgtgagcgtgggcgacggccgacataccagctgtcgtaattttcgactggccctgcggagctcctcccccggtacggatctgacgatatgacgccgaagcacgccgcgccgccgaggccattcgcgccatcttcgcagcccgggtcactcccaccgacgcgccaccggtgactaccgcagccgcagccgaaaccatccgccttcgacccaatccagtgagcttgcgaccaccgctgcgcaccatccggcgagcaccccgcccagcccactggccaatcgccgacgccccttcagagcgcttactacgcatccagtcgttgatcttggccctcagcccctcctcacccttgtgactacgccacagagacaccaagaatccgatgattcccacgatttccaacatgttgacgaccatgaccttgatgacaacgttgccatcagaggcgaagaccgacttgatgacgagcatgaccacgcccagcatcaccatcgacccaacaatgccgatcatcgagtacaagatcgaacacagatcccggataagcgggtctgtgcgaccaggaatagcccgcagcacgttgagcatcgacatgaacgccgaccacaccaacttgcacacgtagaaccagcacatgcccgcgaacaccagcaggattgctgccaaacccgtcaccgttgacgagtaaaagaagaaccccaccaaccaggaaccgtccgcaatatcgccggcgtaatccgataatccctcgtcacaatcaccgaggtcgtcgcgtgcatccgagatatcgtcgtaaggaccacctttgagcacctcgatgtacttgtcgtgacatttggaatcaataatgcggccgtagttgagttgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacaacagggcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccaccgctccccggttccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccagtaatgagccaggcgttggctcggcgggactcacgcacgtactcgtcgatggcgtgggaggcttccggcgaggacgacatgtgatgaaactcgtcaacaatgaaagcggcgtcgcgggcccggtcgctgaagcacaccaggcgagccagacgggcaatgagcgcgtagagggctcggccaaacaccttgtgcgggggcagctgccgaaacagatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatccggtcggcgatcgcggtggcctcgggaaggtcgcattcctcggccaggtggcgggccagacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctggtcgacggtttggcggatggcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcaaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaggtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcaggtttcgggtctgggaggggtttgggctcgtaggtggtgtcgatgtcttcggcgaggacgtggtcgagcaggcaggtggccggggtgtcg

SEQ ID NO: 225 - DNA, 8232 bp, Propionibacterium acnes
gggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacggcagtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttggttggcaggcctgggtttgatcggcttgctgggacccggtttgggctccggagtcttaggctccggcttcacatgcctaggcacttcggctgcggtgggaggagtcagcacgtggcgtactggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatccgagacagcgccacaccgaactgctgggtgcgagccagcggagtagccaacgtcgtcgtatcgcctgcgaacttcgccaccggggccgccaagaaacccaacgccagcgccgcagcaatcgccgcacgcgcacccgtagcccacgccccagccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcgggccggtaatccacccgacccagctcatcgccacggtccagtccaacaaccggcacagcaacgcaatgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccagaaccagcgtggtgacgatgatacggaaccgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggggtaatcggcctcggggtcgtgggagccggtgataagccaggcattggctcggcgggattcgcgcacgtactcatcgatggcgtgggaggcttccggcgaggacgacatgtgatgaaactcgtcaacgatgaaagcggcgtcgcgggcccggtcgctaaagcacaccaggcgagccagacgagcaataagcgcgtagagagcccggccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcaacattgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcgcaatgtgggactggtagacggtctcgccggtgtcggaaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgaggcagaactcgtggcgggcgaggtggcggaataggtcgcggtgagctgcggcgacggtgagggaggcgttctcggtgacgggtcgctggaggggagtgagtcgccaagtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcaaatgtgggaagagtttgtggatggtatcggtgtcctcggcgagggcttggtcgagcaggcaggtggccggggtgtcggtagtctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacccgaagagtccttgccgatgatgcggggctgctggcgggcctcggtgtgccactgaatatccacgatcagctcttgcccaatccttgcatcatctgtccgaagaattggatcgcgttaccttcgataagccagtacgccataccacacacaaacagcatggagacgatcttggccaggctcataccgtgtttgaagatgttgaacgcggcaatgcccacgactacgaccatggcgacggctcgcaccgcggacttgccttcacctgccttgatcgtcgtccattcgaagaggttccgtgtttccagtggcagcaggaggaattgatcgagcatgagaggttttcctttcaggaagccgaccgggatggtcccggtactgacgggctgggcgacacgggtgtgccgtccggaggcagaaggcgtgacggctggtcgagggaggcaacctcccagcggcctgcacgactgacaagagtcaggccgtactggctagtccgggtagtggattcgtcaccggttagctggcatgtcacggtcgcggtgacagcgatcttctgccgatctgagggggtggggatctcgtcaggccccaccacatgagtggttttcaccgatacacacggggctgggtcaatcgccgtgaaagcggtccccgggctactccatctcgacaggtcgtcgctgccactcagcatcgcggccaagaaacccgaagaggtctgggcagccgggtcagcaggacgaatctccgaggagtccacgtcgggggctgaggccggtgcaggcatggggatctgcccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatcggtgcatcgatatacctatgtatctgtctgtggtttttagaggccaccccccgtcgccccgggccgctcagcgataccgcaaggctgtgtgggatcagct

SEQ ID NO: 226 - DNA, 4813 bp, Propionibacterium acnes
ccgaaacgttccagcccgccctgttcgagctagccgactgcgcatgagaccccacacaaacatggttgaatcgaagggctcagccagcagccagttaccaggagtccccgtgcgtctataccgcgctgttcttacccacaccgacatccagatcaccgtccgcatctggagcaccaccgaccacgactggacctggactcccctcgacacctggacccccgacccgaccccgaccacaccagcccagttagccgacgaactccaccgacacggatggaccacccccgaggaccccaccaccctcaccaaggtgactgtgatccccgagaactggcaggccctcgtcgaccacgccctcgctgcccgaaaccaccaagccaaccagctgcgcgtcgccgagaacatcctcaccgacatcctcggcgacgccgccgacgccggcctgtctgtcaccgctctcgcccgcacgaccggactatcccgagtcgccgtctacaaacgcagcgccaaaaccatcgactccatgagacacgccacccaggccggcggaatcctcaccccctcctgtctcacccacgctgagagaacagcgctcggcctgcccgacgagtaacccatcgtttacatcctcgactggtccctgcgaccagtgaaccgtgcccccactgcgcccacaatgatcagcacacccacggcgaccaccaggtgggaagcactaactgatcccaacgaaccaagatcaaacaagccctgcccgggagcgtcgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcggtggcgtcggtggtagcgataagagcatcggtgaggtcgtcgacggcgcggtccagatcagcgatgtccggtagggctacagcagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgctttgccttcttgcccgtggcgcttccgagatgggttcagtgggcgatggctaggccgatgagggcgccgctgcacaggctgggtgcccaggggaggaatcgggtggtgtggtgtcggcagcggtcgatgagggcatatagggcgatcagggtgaggccggctatgaccgtggcgtggatcgtgtcgatgccggttgctgcggccggggctgcccacagtggtgtgatgcgcacgtcggagaagccgaagccgcctcgggagatgagccaggcgatcatccacgccgcggagatgacgacagtagcgatagcagcacggatcgccgcagtctggttcgcgagagcgatcatggccacagccccgatccatccaacccagccggtccaggcgaggactgccggtatccatgtggtgatggcgtcgatgacggctacccatgccccgatggtggctagcagagcccaggccggccaggtgggtgctggggcccacgctacggcggcgatcatggttgtcgcagatgcagcacagacagcgatcatgcttcggagactgtaggtgtcgcggtaggcgattttgtcgggggtggcggtggccggttcgggcaggatgcgagtgagggagggccatcctgcggtcgcaatggtcacgacggcggcgatccacacgatctggtgcatgggtctcatcatggcccaatatcgatgggtgtgggtggccgacatgggctcagtcgtcaagaggtgtacgggcggttgtggcttcttgggtgccgagcatgagggtgccagaatcctcgccggctgattcccagtcgacgatgacctggtcgccgtcaacgctggattcggcgatggtcacccattgcccgtccatatcgatgagcatcccggcggccagctctgtggcggcaaccgggtggggtgggctgtagaggaggtcgatgtcgcgggcagggtcgtcgggttcttcggttacctcgggtggggtcgatctggctgtctcggtgtcgtcggccaggtcggctcccaggatgcgttcccattcggggctggttttcttgcccgatgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgcctcggccgcgtttgccgaacgggatgcccacgccgacgtgttcggagccgaacatcatgcgggctccgtcagcagacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcttcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagagatttcagtgttttatcgaggtgaccagccatccggtctgcgctgcgggttcaggtaccagggtcagatgcaccacggtgtggtcggctaggggcacggcgaccaggggcccgtcggcgctcgccccggtgagggtgggagttccggccacggtggtggcaggaatctggttgggtttcgcggccatcagggagcccatgagggtcggtgcggcgatctggacgagggcgactttgcgggcggcgggatcgcgggtcaaccagccgcgggtgaaagcgagcgccgccgacgtgatatcggggctcagcggggctggagtggcggctgggtgggccgttgaggagggccacacgcgcggtagcg

SEQ ID NO: 227 - DNA, 1095 bp, Propionibacterium acnes
acaccgatcaagcggcctgtatcggcagcattgccgtacctctgcccggcctgatcctcaagccacgacaacgcatcccggaacaaccgcacgtcctccagggctaaaccgcagtcgtagccgcccttgtcccccaacctcacaatctggcgctcccggcgtcctcttttgtcgacctcgatccacagtttcgcgtgcatccgctggcctcggccttctgacaggatctcggtgagcaggtcggacgcctgccctcgcgcatcctcgttactgcgggggaattggagtatgtgggaggaacgacgatggggaaggttggtgacctcatggcgcagcaggttgcgcttgcgcatctgctgatcgagacgctcgggctgacctgttgacggggttgagccgtggcgccgcttcctcggcggggtctcgatccgttgctcttccggcggttcggcgtcaggttgtggtgcgcgatctcccctaggacgggggggctcgccacctatatccgagggacgatgagacggccttccacgcttgctgcgcactttcgcagcccgccccttgcggtcacatcgacgcggcggcggagtgacgtcctcaccgcgcgctagctgcgtcaacgccgacaccaggttggtgcccggtttcagcccttttagcacgaaccgcaccaggcgggggtctcggccgattcgtcgggcaatctcggcttggctccacccctcggctaacagggggcgcaacaagtcttgggcccggttatcacgctcagtcactggtcgccccctcggggagtcctgcctgctcggcctgctctgatagagcagcccgttccgatccggtctggggcgctttcaggggaccgggtaggacacctttgacacgcagccgcccgtccttgccgtcatcgccgcccccctgggccacagggagcgcccaggggggcacgttgctggtgtagatggcgtcgccgtggatagccagcagggtgcgggagttcatgcgtagtgctcctcccttggttgtggcgttttttccggtggtggggtcggcgatgggtgtgttgagggtgcgtacgcgggacagggcccagat

SEQ ID NO: 228 - DNA, 718 bp, Propionibacterium acnes
ccggggccctgctgctggtgtgggacgtcaccgttttgaccgggcccactctcggccaccgcgtgcgtcctctcagtaaggacgccgagctgactgcccggcgctggctcgaccaggtcgccgacaaccccggcttcctcgacacccttatcgaggccgcccgcatcaccgatggatggcatcacgcgacgcctccgcacattcaggccccttaccggacccttcatcagtgaacggaggtacaacgacatgaccagcgacattgacattgaccggacccacaaacccgacgaccgcgccgaggctcctctttaccggtcctgggccaggagactcgtgcacgtctccgggatgccctggcgtatcgtcgccgccttggccggggtctcccccacctccatgcaccggcttctattcggccgcaacggtcgacccgtggaatggatcggcatcaatgatgctcgcgccctgatggatatcggcatcgatgatctcgcctcagcgtccaccgaccgtatcccggcccgcgaatcccgcgagctgttggtagccctgcacaccctcggctggaccgatgagcatctaagccgctggctgaccagttccgacctcgacctggccaccacccccaaggccctctacgtcacccggctatccgccgcccgcatccaggccacctacgacatgctcatcagccagcccgtccgccgctgcggcc

SEQ ID NO: 229 - DNA, 7861 bp, Propionibacterium acnes
tttgtccacccacccctgtcgattttgtccgccaagtattagacaaaccattagacagtgaattagaccctgggtcgcgtcagcgtgtgaactcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcagttcgtggggtggtgtcctcagctggtaggggcaccgaagaaggtgcgtggccagctccgccagatggtcgctgccgagatccgccggaatccgggctggctggatgcgccagcgttggaggttgttgcccagcgggtacgtgctgaaggtgcgctgggggtccagcactgtgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccatcaggcccgagacaccctcacccacgacaacccccatgaacgccgcctagcccgtgacgctgaacgcgcccggctcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacgcacaccatgaaacacgacaagccacctgacagtatcagctgcaagacgcatgacaacatagaaggacatgatgaaatacacatagacacaaccccgcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaaaccgacccattcgcccgccagaaagcagcagaagaccgcgcccaccaactccaagacgaagcccaacgccacgcccaccccaaacgcgtcatcggccccaccgcacgattccagttcgtcctgccagccgacgtgctcaccggcctcaaacacctcgccctcacccgcggcaccaccgcccgccaactcaccctcgacgccctcgacaccgcctacggcctcgacaccctcgccaacagcgggaagaaaacccacccatgacccgtgggtccccctgccaccaccccctcgacggcaactgtgtgcgagccacaggcccgcacacaggcggcagcccagtgccgtccccgccaggaaaggaactgaacttttctggagtgctggctccctatcaccccttatggtgctatcagatccagtagcgccagcccgagaggaaacccatgagctacatcgtccgcaccggaaatctagccggcacccccgagctgcgcgaggggtagccgacacggcggaccgtgcccctgacagtaagcggcactactggagacatcaccatgaccgctcagatcctcgccccgtgcaaccagaaggctgccgtcatcgaaggagccctgccatgaaccaacctaccccccacaaggccgacgagtcacagacgagcaacaccacgaggaagtggcggcacaaggtgtcgttctaccaagacccggccgacaccgaccgagtccgcggagcgatcctccacaccatgacaaccgaaggcaaccggaacctgagccagttcgtcaacgatgccgtcatggccaaggtgaccgaactggaagcaaaatacaaccacggcgagccattccccgccgtgggagcccgaggactcccccagggcggcgcagccgccaacagataagagggcggggaccaccaatagcagtcgatttcggatccagatcgggtagacaggacccatgatgaatttcatatcctccctgctctcggccatcctgaccctctttgcgatggtagccgtggcgataggagtggtgaacattgtgccgggaatatgcgccatcatcggtgcacggaaatacggcgaccaggaccgtgtgcgggcaggacaacgaaagatccttcttggtgctatcgccttggtggtagcagtaggcattcacccgtgacccacggttaccggaagccccgccgcaatcgataccactgtcagtaccatcaggggcgataggggtcaagctctccttgtcacaatcccttccccggcagcccagtaaccgtcgcttacagccatacatggatatgcgcccattcgtcggcaccgacgccgtgcgggttggcgacgctgacccgtctgctcacaaacgacccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgaggccaggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtaaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtggggatgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccc

SEQ ID NO: 230 - DNA, 7938 bp, Propionibacterium acnes
tttgtccacccacccctgtcgattttgtccgccaagtattagacaaaccattagacagtgaattagaccctgggtcgcgtcagcgtgttagctcaccaacgcgcgcgcgcgcggcggccgagccgccgaagccaaagaaacccataccaccaacgcttgaaccagcagcccccgcttcagacagtcctgtgtcagcgcacgctgatgaggctgccgagttggcgtggcggttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggacgtacgactctgacgaaaccagtgacgacgacgaggcgtggagccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccaccaggcccgagacaccctcacccacgacaacccccatgaacgccgcctggcccgcgaacaccaccgcgcccaactcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacgcacaccatgaaacacgacaagccacctgacagtatcagctgcaagacgcatgacaacatagaaggacatgatgaaatacacatagacacaaccccgcacagcagtttcgcaacaaatcatgatagtctcatggcagtatcgcttgatacgcacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaaaccgacccattcgcccgccagaaagcagcagaagaccgcgcccaccaactccaagacgaagcccaacgccacgcccaccccaaacgcgtcatcggccccaccgcacgattccagttcgtcctgccagccgacgtgctcaccggcctcaaacacctcgccctcacccgcggcaccaccgcccgccaactcaccctcgacgccctcgacaccgcctacggcctcgacaccctcgccaacagcgggaagaaaacccacccatgacccgtgggtccccctgccaccaccccctcgacggcaactgtgtgcgagccacaggcccgcacacaggcggcagcccagtgccgtccccgccaggaaaggaactgaacttttctggagtgctggctccctatcaccccttatggtgctaccagatccagtagcgccagcccgagaggaaacccatgagctacatcgtccgcaccggaaatctagccggcacccccgagctgcgcgaggggtagccgacacggcggaccgtgcccctgacagtaagcggcactactggagacatcaccatgaccgctcagatcctcgccccgtgcaaccagaaggctgccgtcatcgaaggagccctgccatgaaccaacctaccccccacaaggccgacgagtcacagacgagcaacaccacgaggaagtggcggcacaaggtgtcgttctaccaagacccggccgacaccgaccgagtccgcggagcgatcctccacaccatgacaaccgaaggcaaccggaacctgagccagttcgtcaacgatgccgtcatggccaaggtgaccgaactggaagcaaaatacaaccacggcgagccattccccgccgtgggagcccgaggactcacccagggcggcgcagccgccaacagataagagggcggggaccaccaatagcagtcgatttcggatccagatcgggtagacaggacccatgatgaatttcatatcctccctgctctcggccatcctgaccctctttgcgatggtagccgtggcgataggagtggtgaacattgtgccgggaatatgcgccatcatcggtgcacggaaatacggcgaccaggaccgtgtgcgggcaggacaacgaaagatccttcttggtgctatcgccttggtggtagcagtaggcattcacccgtgacccacggttaccggaagccccgccgcaatcgataccactgtcagtaccatcaggggcgataggggtcaagctctccttgtcacaatcccttccccggcagcccagtaaccgtcgcttacagccatacatggatatgcgcccattcgtcggcaccgaagccgtgcgggttggcgacgctgacccgtctgctcacaaacgacccttccagcccagcaccacccactacaccgacacgatccacgaagctgaaaccgaacctcccatccccgtccgaaacatcaacgaactcatcaaccccaccaaccatgcatgaacgcaagatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgagacctggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggagtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatacagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggcccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagccccgacgagacgacgcctccgcccgccacaccaacggtcaccgccacggccacggtgaccgtgaccgtggcaccg

SEQ ID NO: 231 - DNA, 770 bp, Propionibacterium acnes
taggcgccccttcggggcacctgtaagcctgtattgctgcggtttacagccttggcacccaaaggggcggcaaggggccaggaggggtcattctgcgccgctgatggcatctcacatgtgagttattctctcaactatcctttaagtcaagcgtattagattatttatccagtactcttgacagtctgtctatcgggctatatatttataagcagaacgagagatcgggaaaggaatcaacgatgaagtacaccgcacacgtcaacatggtgaccaagccctacatcggacttcccactacccgaaccccctacaccctcgtcgacgccgactgggccacaacatggatgatcgacgaaacctacgaagcccactaccacggcaccagcatggagatcagcatctacggcgaaggccccgactgctccgtactcaccaaccgcatctacaccgaccagcccaccgatgtgaccgctgcactcgccggctacggcttcaccatcgacaccaccaacacatccaaaaccatcctcacgctcacccgcacagccaccatctcccacctactagccatcctcgatggcctaccccaagctgaggggactcactggctcaacactcaacccgacctccaccacatcaccctcgacgactccaccaccggctgggccaccaaccgcaccgacgacaccgacaccggcgtctgctacgacaccagcacccacaactggcagatctgctgacagcatgacgggcctgcccttgaaggg

SEQ ID NO: 232 - DNA, 504 bp, Propionibacterium acnes
ttcatgatcgcagtgcccgatacaaggtggagcggcccacaccaagctgggccgccaccttcgttttcgggacaccctcggcaacgaggcggcgagcgcgggcaagctggccctcgctcaatgccggtttccggcctcgatagcggccctgcttcttcgccaccgcgatcccctcggcctgtcgttcatggatcaacgcccgctcgaactcggccaaggcacccagcagatgcaacatgagctggctcaccggatcagcggaccccggcccatagacctgacccccttcaagggcaggcccgtcatgctgtcagcagatctgccagttgtgggtgctggtgtcgtagcagacgccggtgtcggtgtcgtcggtgcggttggtggcccagccggtggtggagtcgtcgagggtgatgtggtggaggtcgggttgagtgttgagccagtgagtcccctcagcttggggtaggccatcgaggatggctagtaggtgggagatggtgg

SEQ ID NO: 233 - DNA, 6850 bp, Propionibacterium acnes
attttgtccacccacccctgtcgattttgtccgccaaatattagacaaaccattagacagtgaattagaccctgggtcgcgtcagcgtgttagctcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcggttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggtcacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccctcctcgacgccatgaaccgcaggaaccgtcgcctcggcctcgacgtgccatgcgccgacgaccagcacaaccccttgggactgttcatccaccaggcccgagacaccctcacccacgacaacccccatgaacgccgcctggcccgcgaacaccaccgcgcccaactcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacacacaccatgaaacacgacaagccacctgacagtatcagctgcaagacgcatgacaacatagaaggacatgatgaaatacacatagacacaaccccgcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaaaccgacccattcgcccgccagaaagcagcagaagaccgcgcccaccaactccaagacgaagcccaacgccacgcccaccccaaacgcgtcatcggccccaccgcacgattccagttcgtcctgccagccgacgtgctcaccggcctcaaacacctcgccctcacccgcggcaccaccgcccgccaactcaccctcgacgccctcgacaccgcctacggcctcgacaccctcgccaacagcgggaagaaaacccacccatgacccgtgggtccccctgccaccaccccctcgacggcaactgtgtgcgagccacaggcccgcacacaggcggcagcccagtgccgtccccgccaggaaaggaactgaacttttctggagtgctggctccctatcaccccttatggtgctatcagatccagtagcgccagcccgagaggaaacccatgagctacatcgtccgcaccggaaatctagccggcacccccgagctgcgcgaggggtagccgacacggcggaccgtgcccctgacagtaagcggcactactggagacatcaccatgaccgctcagatcctcgccccgtgcaaccagaaggctgccgtcatcgaaggagccctgccatgaaccaacctaccccccacaaggccgacgagtcacagacgagcaacaccacgaggaagtggcggcacaaggtgtcgttctaccaagacccggccgacaccgaccgagtccgcggagcgatcctccacaccatgacaaccgaaggcaaccggaacctgagccagttcgtcaacgatgccgtcatggccaaggtgaccgaactggaagcaaaatacaaccacggcgagccattccccgccgtgggagcccgaggactcccccagggcggcgcagccgccaacagataagagggcggggaccaccaatagcagtcgatttcggatccagatcgggtagacaggacccatgatgaatttcatatcctccctgctctcggccatcctgactctctttgcgatggtagccgtggcgataggagtggtgaacattgtgccgggaatatgcgccatcatcggtgcacggaaatacggcgaccaggaccgtgtgcgggcaggacaacgaaagatccttcttggtgctatcgccttggtggtagcagtaggcattcacccgtgacccacggttaccggaagccccgccgcaatcgataccactgtcagtaccatcaggggcgataggggtcaagctctccttgtcacaatcccttccccggcagcccagtaaccgtcgcttacagccatacatggatatgcgcccattcgtcggcaccgacgccgtgcgggttggcgacgctgacccgtctgctcacaaacgacccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgaggccaggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtaaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttggggtctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttg

SEQ ID NO: 234 - DNA, 6142 bp, Propionibacterium acnes
atctgctgacagcataacgggcctgcccttgaagggttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactcccccaccctcgtgtagtacactatactacacagtcattgaggatagaggtgacgtcatgagtttttcgatccgtttaaccgaccatgagcgccgcttagctgattcctacgcccgcctgcactcgcagtccctgagtgaggctttcaagcaagccctcttcgaccgcatcgccgacgagttcgatctgcaagtagcccgtgaggcactcaccgactacgcccgcgacaactaccagtctcgccccatcagcgagctatgggacgagtgtgacctatgagctggcagatcgaaaccacgagccggttcgataaagaattcaaaaagctagaccgctacacccaaaaactcattcacggctggatcacgaaaaacatcgacaacaccgacgatccccgccgccacggcaagcccctcaccggtgatctttccggactgtggcgctaccgcatcggcgactaccgcctcatctgcacactcaacgataaccgcctcaccatcctcgccctgtccatcggtcaccgccgcgacatctaccgataagccgttgcaagactgcggcgtcgacaccgccgggaccctggcccaggccttgggcctggaggaggacgagagcgaggagcacgccgcctgagcggtcgccggcacttcccataacagcaccggtcccggcggcccggccccgcgtctggtgctcggaccgatgccggcgcctggcctccgacgcccgccggggccagcggctgggctacctcgacgtcgacgtacaacgggccgaacgaaccgtgcgctgatttaccaccgcttccgcacagagaacatgcctctgactaggagaaatgacgttttccacagggcctctattactaatatccctattatctctatccacgcgcgcgagcctcagcgttcaagcttcaggtcttgctcgtctccctcgcgcctcgctgcgctcgttgctactgccgccccacccggcaagccgggtgggttgccatcggaataccgtggaccatcccggcgcatacacccagacggtccaagatccaatccacgctcacccgcgacgccgctaacgatcctcatacaccgtagatgccgttctgagagccttccagacccgcacgtgggtttattgcaccgagacccaaatcccctcagaagcgatcctgaaaccgtctacgccccatttccgacggacgctggacaggctgggcggcttgtctcccgccgcagacatggccctggcatatgcggttgccgactggtgggatcagggattggatcacacggcagacggctggtccaaggcgggtgtgcaggtgcggtgagcggcagacgtgaccggtggggtgcactgtcatggccgggcatctgccgagccaccatgcgggccctggaccaggaggcagcccgctgcgaggactgggggaagacggcggcacggatgggccgtcgggatgcggcggccggattcaccgagactgcggtgcagcatcgtggacagatgcaccacctcatgtcggcacaaaaagtgtgggtgtcgaccgacatggtgtcggctacactggacgccgcaggagacgtgccgagtttcgaggccgtcgacgtccctgccgccgggctcatgggtttggccagccccctgccgccggttaccctgcagcatccgctgtatctgcgcagcgacgagggtgtgacaaccttcactgatccggttctcgtcgacgcgctgggatggtggatggattctgggcgtgtgcacgtggtgatgtgcacacgcacaccccggctgcccaacccggtttatgcggtggcctccccactgacggtggtggagaaaatcacggtgcccaccggcatcgagttcgagaccatggagtccaggatcctgacccccggcggcgtgacaggcgtctcacggcagggcacacgcatgatgatccggttggcgtcatggctgggtgccgcgtgggtgctcatggcgactccgacggtgtcggagccgcaccctatggatggccggtggggaggcccagcaacggggcagacccggccgcgtgatcgggtgaccgtggtcgacatgcggcccatgaggcaggtgcacaccaccaccgaccccaccggcaggcggttgacgacccggcatgtcgtgcgaggacactggacacaccaaccctacggcccggcccgcagtctccgacgcctgcagtgggtcgccccattcatccgcggccccgaaggggctccgttcgtcggcaccgacaccgtcaccgtatggcgccgctagatacgcgggcgcggggggttgacgaacgatgcccccctctttgtgttgtgatcagtcgtgatcggcgggttttaggtcggggtaggtgtcgagaatggccttgaggacgaggtcttggattgtggtgtcattctgggctgccttgaccttcagtccaacgccgatgtcccgggggattctggtctgcaacttgaacaggtctgcctccttggttttgaacagtttggctgcagggttggcaacgggctgttcttggcgctggcgtccaaggttgcttttctttcgggcggtcatgacatcatctccaacagttcgtcggcaacatcggcgaagaaggcgatagtttccggctcaggggtacagccgtaggcgcgcttgatgacttgacgcttggggatgacgtgatcgaccaactgcgtctgggagtcgttggctagaaggtcgcgaccttccttgaacagggaggtattcggttcagctttggaaagcagcaccacgcgcggggttcctgcggcggcgtcgtgcgtctcccaggtgcgcgccatgtcgagcccggacgtgtcggtggggatgataaccagatcggcggcgcgaatggcggcggtgatgatgtcaccgttgcccggcggggtgtcaatgatgacaacttcttcgggtccggcgacgaggtgctggagcgtcgccttgttggccggttccacggggaaccccaaggggtcggcgttactcagtgtgcactcggcccaggatgatgctgacccttgagggtcggcatctttgacgcggaccatacggcccgtctcatggagagctgcagccagcaggatcgctgccgtggtcttaccgacgccacccttggcgttgataatgctccagatcatggtgacacctttcagtgaggatgcatatcagtttacctgcaaggagtaaagacggcaagcagttatgccgtttctgcggcaagccgtcttgcatccttggatgtatagatagttgtctacttatggttgtggatcgtggtgtctcgtaccaggatttagtgtgctcgctgatatgcacgactttcgggcggcctgatctggcggtggtgccactaacccaggagtctgatccgcaaggtgtcctcgactttgaggaaggggtctctgctttcgtgttgacctaaagtcaacggccctgggcgatcactgaatcctaataactttgtatccttccctgattgcatcttagcatccttgaattcaaacagggatggagccatgctgttttgacgacatggatgcactggggtttggttgttgccgatgcggagcgtcaggcggcccgggacgccgccaccgccgacacgctgcgggagatcgtgggactgctgggccggggcggcgaggtcccgcccgccaagacggggcgtaagacgaccggcaggccggccccggcccgcaagtcgtcggccacgcagtaaaggcagggatccgtccctacgcagagagcggaggcagatcctgggggatccgactcttcggttccgtgatcttcccggagatcttcccggatcccccagggctcatcctgatacggggtccgccgacggaccccgtatcagtgggggcgctgccaccagtgatggcgggcgggtcggtcggcgtctaggccccgcccgatggtcgcctggtctacctcgcaggcccgtgctgttgccgaggccgagaacgtctgcccacttgttgccgattcagtcccctctccgtctgccatgtcgccaacctttcctatctggcgtgctcatggacatgcccgggcacgccctcgctgctcagaggcctgctcgttccacctctggccgcgaaccgtatttctgctgaccactcctcgtgcgtgaatatttgccagccttggccattcatatttggactactctgcaccagatatcggactgggaaacctcttgcacatctctaattgtcatctattcgttgggcgcgcgctgttagatcgtgatcataccaatcagaagacaaagcgacgcccttttgagcggcttttcgaacgattctagaccgcgctatatcagcatttctaccgcgcggccagagtgctacactaaattcctctctgcaatccttaagtccattctttacttcctcatccaatttctgcgacagcatttttatggaagcatcgcactctgactcatcatcaaatgcctcaattgcgtgcgttcgccattcacggcgcgtattatcgtagccgtaatgaagtattacccaccgatccacagaatcatcgttaggatctacaactgtcatgaatggcccaactctcgctctggtgtattctcaattgcagttcagtgactttacttgaccagtcccggatttagtagacgtagacggagagtaccccgccgggaacttgactgacatcactgctgtaccgtactgctttcccgggtggcaaccatcgtaagcagcatttgccgtgacgtacctagtgctctttctctgagtgccggtaatcgccttatatggtacaggtgggtgaatcgtagccgttacggctaccgatgacacgtttgcatcacatgaagctgtggcgacataattagttgtcccattgacatgatgagagtcgtggacatactgtcgaggatcgagagtgcaggttattgttgacgccgttgttctggtaccagctgctttcgagctctttgttgcagttacagtctgcggccctgaaggttttactgacgcgactgatgtgttcgcgtgttttgcggcagtgctttgatttggttgtgcttgtgtagcagttgctgatgtcgccagtgatgcccccattaccatagctgtgattatggcgtagtctttacgcttcattgcgcccccaaataagcatgttagtttgctattttgaataggatacgagacatcgccatgacttgtcaagggcagaagtagaaagaatcggggggtatcaagaaagatgtgctttcatcaggacgaaagcggatgggtccgttcgacttggtgacgaatgatccggccttgcgtcgcggagaccaggccggcgagtttgtcgagcagggccgccgtggcctcatcgtcgggcacatcactaaagggacgaacaaccatgacggctagggccagaaacgaccggaactgaatcgcatgtggacccccatctggcaccaggcacacacctaccgaccggaaaccctgcaccctgtcgctcccagttcacctcctaatatgcgcctatagtctgtgctagtagacattattttgtgtgttgtttcccatctggcatgtctggccccggacccgccgcgacacgcggtggtggataacagaccaggacccccggaccatagagaccagggggacgagacagtcccccggtgaggatgtctcgatgtgcagatcaggaacagaatcgccgggcacgacccggcgccggtgccggtgcagtgaacccgtggcccatcgactccacgaacgaacgtctcgccttcctcaactggtgttggcggcaaggctactcagcagccatcgtggaa

SEQ ID NO: 235 - DNA, 5731 bp, Propionibacterium acnes
tgcgctgatttaccaccgcttccgcacagagaacatgcctctgactaggagaaatgacgttttccacagggcctctattactaatatccctattatctctatccacgcgcgcgagcctcagcgttcaagcttcaggtcttgctcgtctccctcgcgcctcgctgcgctcgttgctactgccgccccacccggcaagccgggtgggttgccatcggaataccgtggaccatcccggcgcatacacccagacggtccaagatccaatccacgctcacccgcgacgccgctaacgatcctcatacaccgtagatgccgttctgagagccttccagacccgcacgtgggtttattgcaccgagacccaaatcccctcagaagcgatcctgaaaccgtctacgccccatttccgacggacgctggacaggctgggcggcttgtctcccgccgcagacatggccctggcatatgcggttgccgactggtgggatcagggattggatcacacggcagacggctggtccaaggcgggtgtgcaggtgcggtgagcggcagacgtgaccggtggggtgcactgtcatggccgggcatctgccgagccaccatgcgggccctggaccaggaggcagcccgctgcgaggactgggggaagacggcggcacggatgggccgtcgggatgcggcggccgaattcaccgagactgcggtgcagcatcgtggacagatgcaccacctcatgtcggcacaaaaagtgtgggtgtcgaccgacatggtgtcggctacactggacgccgcaggagacgtgccgagtttcgaggccgtcgacgtccctgccgccgggctcatgggtttggccagccccctgccgccggttaccctgcagcatccgctgtatctgcgcagcgacgagggtgtgacaaccttcactgatccggttctcgtcgacgcgctgggatggtggatggattctgggcgtgtgcacgtggtgatgtgcacacgcacaccccggctgcccaacccggtttatgcggtggcctccccactgacggtggtggagaaaatcacggtgcccaccggcatcgagttcgagaccatggagtccaggatcctgacccccggcggcgtgacaggcgtctcacggcagggcacacgcatgatgatccggttggcgtcatggctgggtgccgcgtgggtgctcatggcgactccgacggtgtcggagccgcaccctatggatggccggtggggaggcccagcaacggggcagacccggccgcgtgatcgggtgaccgtggtcgacatgcggcccatgaggcaggtgcacaccaccaccgaccccaccggcaggcggttgacgacccggcatgtcgtgcgaggacactggacacaccaaccctacggcccggcccgcagtctccgacgcctgcagtgggtcgccccattcatccgcggccccgaaggggctccgttcgtcggcaccgacaccgtcaccgtatggcgccgctagatacgcgggcgcggggggttgacgaacgatgcccccctctttgtgttgtgatcagtcgtgatcggcgggttttaggtcggggtaggtgtcgagaatggccttgaggacgaggtcttggattgtggtgtcattctgggctgccttgaccttcagtccaacgccgatgtcccgggggattctggtctgcaacttgaacaggtctgcctccttggttttgaacagtttggctgcagggttggcaacgggctgttcttggcgctggcgtccaaggttgcttttctttcgggcggtcatgacatcatctccaacagttcgtcggcaacatcggcgaagaaggcgatagtttccggctcaggggtacagccgtaggcgcgcttgatgacttgacgcttggggatgacgtgatcgaccaactgcgtctgggagtcgttggctagaaggtcgcgaccttccttgaacagggaggtattcggttcagctttggaaagcagcaccacgcgcggggttcctgcggcggcgtcgtgcgtctcccaggtgcgcgccatgtcgagcccggacgtgtcggtggggatgataaccagatcggcggcgcgaatggcggcggtgatgatgtcaccgttgcccggcggggtgtcaatgatgacaacttcttcgggtccggcgacgaggtgctggagcgtcgccttgttggccggttccacggggaaccccaaggggtcggcgttactcagtgtgcactcggcccaggatgatgctgacccttgagggtcggcatctttgacgcggaccatacggcccgtctcatggagagctgcagccagcaggatcgctgccgtggtcttaccgacgccacccttggcgttgataatgctccagatcatggtgacacctttcagtgaggatgcatatcagtttacctgcaaggagtaaagacggcaagcagttatgccgtttctgcggcaagccgtcttgcatccttggatgtatagatagttgtctacttatggttgtggatcgtggtgtctcgtaccaggatttagtgtgctcgctgatatgcacgactttcgggcggcctgatctggcggtggtgccactaacccaggagtctgatccgcaaggtgtcctcgactttgaggaaggggtctctgctttcgtgttgacctaaagtcaacggccctgggcgatcactgaatcctaataactttgtatccttccctgattgcatcttagcatccttgaattcaaacagggatggagccatgctgttttgacgacatggatgcactggggtttggttgttgccgatgcggagcgtcaggcggcccgggacgccgccaccgccgacacgctgcgggagatcgtgggactgctgggccggggcggcgaggtcccgcccgccaagacggggcgtaagacgaccggcaggccggccccggcccgcaagtcgtcggccacgcagtaaaggcagggatccgtccctacgcagagagcggaggcagatcctgggggatccgactcttcggttccgtgatcttcccggagatcttcccggatcccccagggctcatcctgatacggggtccgccgacggaccccgtatcagtgggggcgctgccaccagtgatggcgggcgggtcggtcggcgtctaggccccgcccgatggtcgcctggtctacctcgcaggcccgtgctgttgccgaggccgagaacgtctgcccacttgttgccgattcagtcccctctccgtctgccatgtcgccaacctttcctatctggcgtgctcatggacatgcccgggcacgccctcgctgctcagaggcctgctcgttccacctctggccgcgaaccgtatttctgctgaccactcctcgtgcgtgaatatttgccagccttggccattcatatttggactactctgcaccagatatcggactgggaaacctcttgcacatctctaattgtcatctattcgttgggcgcgcgctgttagatcgtgatcataccaatcagaagacaaagcgacgcccttttgagcggcttttcgaacgattctagaccgcgctatatcagcatttctaccgcgcggccagagtgctacactaaattcctctctgcaatccttaagtccattctttacttcctcatccaatttctgcgacagcatttttatggaagcatcgcactctgactcatcatcaaatgcctcaattgcgtgcgttcgccattcacggcgcgtattatcgtagccgtaatgaagtattacccaccgatccacagaatcatcgttaggatctacaactgtcatgaatggcccaactctcgctctggtgtattctcaattgcagttcagtgactttacttgaccagtcccggatttagtagacgtagacggagagtaccccgccgggaacttgactgacatcactgctgtaccgtactgctttcccgggtggcaaccatcgtaagcagcatttgccgtgacgtacctagtgctctttctctgagtgccggtaatcgccttatatggtacaggtgggtgaatcgtagccgttacggctaccgatgacacgtttgcatcacatgaagctgtggcgacataattagttgtcccattgacatgatgagagtcgtggacatactgtcgaggatcgagagtgcaggttattgttgacgccgttgttctggtaccagctgctttcgagctctttgttgcagttacagtctgcggccctgaaggttttactgacgcgactgatgtgttcgcgtgttttgcggcagtgctttgatttggttgtgcttgtgtagcagttgctgatgtcgccagtgatgcccccattaccatagctgtgattatggcgtagtctttacgcttcattgcgcccccaaataagcatgttagtttgctattttgaataggatacgagacatcgccatgacttgtcaagggcagaagtagaaagaatcggggggtatcaagaaagatgtgctttcatcaggacgaaagcggatgggtccgttcgacttggtaacgaatgatccggccttgcgtcgcggagaccaggccggcgagtttgtcgagcagggccgccgtggcctcatcgtcgggcacatcactaaagggacgaacaaccatgacggctagggccagaaacgaccggaactgaatcgcatgtggacccccatctggcaccaggcacacacctaccgaccggaaaccctgcaccctgtcgctcccagttcacctcctaatatgcgcctatagtctgtgctagtagacattattttgtgtgttgtttcccatctggcatgtctggccccggacccgccgcgacacgcggtggtggataacagaccaggacccccggaccatagagaccagggggacgagacagtcccccggtgaggatgtctcgatgtgcagatcaggaacagaatcgccgggcacgacccggcgccggtgccggtgcagtgaacccgtggcccatcgactccacgaacgaacgtctcgccttcctcaactggtgttggcggcaaggctactcagcagccatcgtggaaacgatggacgccgcgggagcctacgaccacctcgacgacgaccagaccagcaaccagcacgactaacgccgctcccagcacgggggaaggcggcgcaccaggtgcgccgccttcccccgtgctggtgtctcgtcggcttactggtgggggtcgtaggggaacccgtaggtgtgttccagggccttgcggagaaggtcgttcatagttgtgtgttcggcgacggccttcatcttcagcgccgtgtgggtggcggtgggtagcttgacgttgaacgcggtgatcggggtcttggccgactggaaggtttcagagacactggctccctggctggccgccatttggtcggcgtaacggctggctttgtcggcggcggtgggtttgcggttcttactcacttcagcatctccttgattcggtcggcaacctgggcgaactctcctagatctgttggccgggttccgatggcttgccgataggcgacccgtcgatgaacctccgcatcgagaacgtctaggccctcaacggcggcggccccctcgtgggcatcacggtattgcctggtccaatcggctttgttgaagagcagggcccggcgtgtgccgtgggccacctggtaggtcattagcgctcggtccatgtccaggtcccccgactcggtcgggatgatg

SEQ ID NO: 236 - DNA, 5381 bp, Propionibacterium acnes
cacccacgacaacccccatgaacgccgcctagcccgtgacgctgaacgcgcccggctcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacgcacaccatgaaacacgacaagccacctgacagtatcagctgcaagacgcatgacaacatagaaggacatgatgaaatacacatagacacaaccccgcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaaaccgacccattcgcccgccagaaagcagcagaagaccgcgcccaccaactccaagacgaagcccaacgccacgcccaccccaaacgcgtcatcggccccaccgcacgattccagttcgtcctgccagccgacgtgctcaccggcctcaaacacctcgccctcacccgcggcaccaccgcccgccaactcaccctcgacgccctcgacaccgcctacggcctcgacaccctcgccaacagcgggaagaaaacccacccatgacccgtgggtccccctgtcaccaccccctcgacggcaactgtgtgcgagccacaggcccgcacacaggcggcagcccagtgccgtccccgccaggaaaggaactgaacttttctggagtgctggctccctatcaccccttatggtgctatcagatccagtagcgccagcccgagaggaaacccatgagctacatcgtccgcaccggaaatctagccggcacccccgagctgcgcgaggggtagccgacacggcggaccgtgcccctgacagtaagcggcactactggagacatcaccatgaccgctcagatcctcgccccgtgcaaccagaaggctgccgtcatcgaaggagccctgccatgaaccaacctaccccccacaaggccgacgagtcacagacgagcaacaccacgaggaagtggcggcacaaggtgtcgttctaccaagacccggccgacaccgaccgagtccgcggagcgatcctccacaccatgacaaccgaaggcaaccggaacctgagccagttcgtcaacgatgccgtcatggccaaggtgaccgaactggaagcaaaatacaaccacggcgagccattccccgccgtgggagcccgaggactcccccagggcggcgcagccgccaacagataagagggcggggaccaccaatagcagtcgatttcggatccagatcgggtagacaggacccatgatgaatttcatatcctccctgctctcggccatcctgaccctctttgcgatggtagccgtggcgataggagtggtgaacattgtgccgggaatatgcgccatcatcggtgcacggaaatacggcgaccaggaccgtgtgcgggcaggacaacgaaagatccttcttggtgctatcgccttggtggtagcagtaggcattcacccgtgacccacggttaccggaagccccgccgcaatcgataccactgtcagtaccatcaggggcgataggggtcaagctctccttgtcacaatcccttccccggcagcccagtaaccgtcgcttacagccatacatggatatgcgcccattcgtcggcaccgacgccgtgcgggttggcgacgctgacccgtctgctcacaaacgacccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgaggccaggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtaaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtggggatgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtcc

SEQ ID NO: 237 - DNA, 5561 bp, Propionibacterium acnes
gggatgaggatgacggccgcgccgacacttcggagcgaggtcatgtgacgatccttcggtagctcgacgggttgccgtagatcttttccacgttgatgccgctgtgggggttgtcggcgctaaccatttggcctccaccgatgtagacggccacgtggtgggcagggtttccccagaggatgaggtcgccgactttgagctggtcacgggccaccgcggtgccgacgtgctgttgttcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgcgggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtactggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgaaggctctgtggcccgtcgttgccctcaccggtgcatccttgccctggcgggtctgcttagcgatcgccgacatgccgcctcgcaatgccgaaacacggttgtgggcgtgggcgatcgccgacataccggccgtcgtaattttcgactggccctgcggggcccctgccccagcacgaatctgccggtaagccgccgacgtgcgacgagcacccgccgccattcgcgccaccttcgcagccctagtcactcccgtcgacacgccacccgtggctaccgcagcagcacccgagaccacagtcgaggccatccgccttcgacccgatccagtgagcttgcgaccaccactgcgcaccatccggcgagcaccccgcccagcccactggccaatcgccgacgccccttcagagcgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatccgagacagcgccacgccgaactgctgggtgcgagccagcggagtagccaacgtcgtcgtatcgcctgcgaacttcgccactggggccgccaagaaacccaacgccagcgccgcagcaatcgccgcacgcgcacccgtagcccacgcccctgccgtacgtcccctcatcatcttgacgaccacgcccacaccggcgcacgtcgtcagcaacgtcaacaccgttccaccccagctgtccgctcccagcggggccaaaaccttgtcgtggatgtcgttctgtaaccccaccagcggtccggtaatccacccgacccagctcatcgccacggtccagtccaacaaccggcacagcaacgcaatgaccatcaggtacgtgttccaacacatgccaataatggaggcccacatactcttcagcggggccgtaacgccaccatcgtccatcgacatctggtactgaaacaagtgaataccgttggagtcagtcacattgaaaccgtcacccatccagcccagccccgggcccgatgccatggcaggcacactgctcagcgccaccaccaaaaccagcgtggtgacgatgatacgaaatcgccgctccccggccccggggcggcgtggatgacggctcacgctgtctcctggtcgtgctcgggcgggttggagctggcggcttcgcggtggggagcgtaggcaggtctcagtagtcgaatttcaccgacgttgccgtgttggtcggcgtacaggccacaaccggggcctccggggttgagggcaatcttgaccaggtcagcgaactcttcaggggacgtcttgggatctacgcccaggaactcgacacctttctgggcgaggttgatgttgtcgcacagcaacacgatgcgatgctgaatgaggttgcggacggtctcgttggggtaatcggcctcggggtcgtgggagccagtaatgagccaggcgttggctcggcgggattcgcgcacgtactcatcgatggcgtgggaggcttccggcgaggacgacatgtgatgaaactcgtcaacaatgaaagcggcgtcgcgggcccggtcgctgaagcacaccaggcgagccagacgggcaataagcgcgtagagggctcgaccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagtgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcaacattgtcgagctgatcgaccgtttgacggatagcccgctgatttttctgcatcgcagcgtgacgggtccgggccactccccggatcgccacgtcgaccggcacgccagtgtcgtcgatacggcccaggaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgtggggtcggtccaggtgagggctccgttgag

SEQ ID NO: 238 - DNA, 4899 bp, Propionibacterium acnes
gataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactgatgaacaccccagcgctgatagcagccctcatcgtgaccggcctgggactgatcatggccatcaacggcctgatcccggccacacccaaacccggcaccacgctgacgctgtcacagcggtgggcccgggccacccaccgcccagccggggcagccgggcgccgacgcgacctgcgctgggcgctggccggtctcgtcggcatcgtgctgttcgtcctcacaggttgggtcgctgccctggccctgggccccatcaccgtgctgctagcacccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgaatggcgcggcgggtgctgcggcccgtgcggcgtcgttggagcgtgatggacagtcggctcagtctgcggcgcagcaggcggcgtcggcgaacctgtcgtccggtgggctggcatgtgcgccgaatgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccggcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtgacggcg

SEQ ID NO: 239 - DNA, 5203 bp, Propionibacterium acnes
gcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggatctgtcccagcgcggaatgatgccggtggaggtggcccggttcctcgatgaggcggtgcaagctggcaagtccattgtggtcgccggtgagcagggtgcaggcaagacgacgtttttacgagcgttgatccacgccattccgatgcgggagcggttcgccacgttggagaccgaccaggagttgttcgctcatctgatgcctggccgacaagacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcctcggccatgttccaggccatgcagtcgggtacaggcaccatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgttgaccccgctcatgcctggttcggccgccgacgagctgtctcacttcgcccgagacctggattactgcgaggcccactcatgaacactcccgcactaaccagcgccctcatcatggccgggctagggctgatcctggccatcgacgggctggtcccggcgccgcctcgacctggggccccgctgagcccggcccaaaggtgggccaggctcacccaccgtcccacaggagcggccgggcgccgccgggatttgcgttgggggttggctgttctcgtcggcgtcgtgctgtttgtgctcaccgggtgggtggctgcgctggcgttgggccccatcattgtgttgttggcccccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcacccgcggggagcctcgacaacgttgaaagctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtgaccgtggcggtggtcatgtatgtcatcgcactagtgcagatgtatcggatggcgcggccccgtcgacgcacccggatcatggttaggaggagtcgatgacgacgactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataaggatgcctgtaagcaccacaatattgatcacaacctaacaatgaaggagaaatcatgatgaccgatctcgacctggctaaaaaacagatcacctggctggcggcgtacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatgcgcggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggcggagcaagtctaagcgtcgaggtgctcatgtgggcgccgatcgcgctggtgatcatcgggtttgttgtgggtatcggccggatgtcgatggcccaggacgcggtgagtggcgcggctggtgctgcggcccgtgcggcgtcgttggagcgtgatgggcagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttggattcgggtcccggacggtgcacgcaacggggtctgccccggtagacacctatcgggaaaggagaggctgagatggcccgcgatgagcgtggtggcggctcggtgtcggtgtggatgctgctcatggtgccagtgattctggtcatggccggcctggtttttgacgggtcccgtcagatatcggcaacccaggcggcccaggacgcggcggttgcggcatcccgcgccggaactgatgcggcagcgacaccgcagctagctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccggcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcacggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtgacggcgcccaattccgtcgtatcgccgaagcctccggtatcgacccgcactcagagctgaaagtcggccagaaactggtgctaccggttcccgagaacacggccgcgatccattcggttaaagcgggggagtatctgtgggagatcgccgagcactactacggtgacggcgcccagtaccataaaatcgcggaagcttccggtatcgatgcccattccgatctagccgtgggccaaaaactcgtcatccccgggcccctccgccacgacgccacgccgccacaccactcggcgtcgacccacgcgaag

SEQ ID NO: 240 - DNA, 2238 bp, Propionibacterium acnes
gacgccggccaccccaactactccgacccacacggtgaccccagctccggcctctgccggccactcgaccagcgacgagcacccactccatacggataccgccacagcggacaaggccagcgacgaggacgccctgtccccaatccaggtgggcttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgacgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccagctctagtcacactgggacgcgacgacgacggcgcccacatcctcatcgacttggaagccgcaggaaccttgcacctgatcgccgacgacgaccaggtcgacgcagccctcgccgccatcgccgtggaactggccacctgcgactggtccgacgaagtcaacgtcaccctcgtcggccaagtgtgcccgggcctagaagaggccttgggctctccaaccctgacccgcgccaccgacgtcgacgctctcttggagacgttggaggctcgcgccgacgatcagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccacacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccaggttcgcgtcgacaccgaccaacccggcaccgacacccccttccccatcgacgacatcgacccgctgagctccgaccacccggtcctatccatcatcggccaccccgacatcacaggtgccactggaaccgttgggcgctccccgtggcgctgccaacagttggccctctacatcgctgagcatccgggagcatcgggggcgactatcgccgatgatttggggctatcagcgccgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggagacttggggctggcccggtgggcgctgacccaagggctactggtgtctcccgatcatgaggacctggtcgccggttgtctgcgcaccgaataccaggccggcaacatggacaaggtcgccgagctggtcgatcacctgtcggctaccgcacgccgactgggcgtcgacctcaacgaggacaccacccggatcatcgatacggtcacccacgccgacaggagagcatcatgatctcccctgcactcatctccgtcaggaaggttcctatgcaccat

SEQ ID NO: 241 - DNA, 739 bp, Propionibacterium acnes
acgtgcgggtacacctaccagcaggcagccccggaaggcggttatcaggtcaccgcaatcacgtcgtgggatgtgacctggtcggtactaggacacacgggcacagtccatatcgagaaggccggtgggcagatgcttccggtcggcgagttggagtctgttgttacacggcgatgactcctgatagtccgacgctgtatgaggtgttgggggtctgccctgatgccactgatgaccagatcaagacggcgtggcgtcgtgccgcgaaagtgactcaccctgatgccggtggcactagtgaggcgttcgcggccgcccggcacgcctgggaggtgttgtctgatcctgcccggcgcaccgcctacgatgccgacctggcgggggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcggtgacgggtctggcatttttcaccatggcggccatctggtgtggatggtcgttgataggtggtgcgttgctgtggggccagacgtc

SEQ ID NO: 242 - DNA, 4920 bp, Propionibacterium acnes
ggccatcctgcggccgcaatagccgcgacggcgaccacccacacgatctgttgcatgggtctcatcatggcccatcatcgatgagtatgggtggccgacatggggtcactcgtagaggggatcgaggggtgtgcgggcgagcatggcttcctgtgtgccgagcatgagggtgccagagtcgtcgccggccgattcccagtcgacgatgatctgcccgctgtcgacgctggattcggtgatggtcacccattctccgtcgatattgatgagcaccccagcggccagctctgtggcagcaaccgggtgggctgggctgtagaggaggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggattcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcaccaacagtcggggcagacgctggccgcttcgagaccgaggagggacgagacaagggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcaccacggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggtgtggcggcggggtgggccgttgaggagggccatacgcgcggtagcgctggcgacatcgagcgggtcggagtggggtcaggtgtggggcttagggtccgatgtggcgatggggctaccgccccggtggtgggagacgagactggttgggggtggtgttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacagcagtgccgactttctgctggtcggcggcggtgcggggaaggctaatgccgatacgccggtacagcgccgaggtcaggcctgagcagtcgtagccgccatcggctttgccgttaccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtggcccgtcgttgccctcaccggtgcatccttgccctggcgggtctgcttcgcgatcgccgacatgccgcctcgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccgatccggtgagcttgcgaccaccactgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccc

SEQ ID NO: 243 - DNA, 4903 bp, Propionibacterium acnes
gcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggctagggctgatcctggccatcgacgggctggtcccggcgccgcctcgacctggtgccccgctgagcccggcccaaaggtgggctcggctcacccaccgtcccactggtgcggccgggcgccgccgggacctgcgttgggggttggctgttcttgtcggtgtcgtgctgtttgtgctcaccgggtgggtggctgcgctggcgctgggccccatcattgtgttgttggcccccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgagtggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggccggcacccaggacagccccgccaccacctctcaggccccggacgcctccaccactccgaaaatctggaagacctacacggtgcgggccaacgactacctgtggaagatcgccgagcactactacggtgacggcgcc

SEQ ID NO: 244 - DNA, 4609 bp, Propionibacterium acnes
gataccgcaaggctgtgtgggatcagctgtgccgctctcccgacatggcagacagcaccctgcggactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcgtatcttctagcaattgatctagctatgtatatagctgatgatctagctaccatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgtcgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcag

SEQ ID NO: 245 - DNA, 4613 bp, Propionibacterium acnes
gcgataccgcaaggctgtgtgggatcagctgtgccgctctcccgacatggcagacagcaccctgcggactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcgtatcttctagcaattgatctagctatgtatatagctgatgatctagctaccatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggggcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgtcgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagct

SEQ ID NO: 246 - DNA, 4903 bp, Propionibacterium acnes
gcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcagcggaagtgtcattgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagtctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcatttcgcccgagacctggattactgcgaggcccactcatgaacactcctgcactaaccagcgccctcatcgtgaccgggttggggctgatcctggccatcgacgggctggtcccggcgccgcctcgacctggtgccccgctgagcccggcccagaggtgggctcggctcacccaccgtcccacaggagcggccgggcgtcgccgggatttgcgttgggggttggctgttctcgtcggcgtcgtgctgtttgtgctcaccgggtgggtggctgcgctggcgttgggccccatcattgtgttgttggcccccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagagaggcgttccagcggatggccgacgagctggactcggctgaggctgacgcggtgctggcctctctggcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttgtacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcttacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatacccggatatcggtcagtgatgacggggccactgtcacggtgaccgtggtgggccgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgagtggcgcggctggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtgaccgggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtgacggcgcc

SEQ ID NO: 247 - DNA, 4612 bp, Propionibacterium acnes
gcgataccgcaaggctgtgtgggatcagctgtgccgctcccccgacatggcagacagcaccctgcggactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtcttgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttttggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacctctacctgctagaaacatagccatgtctccagcaacgcatctagcgtatcttctagcaattgatctagctatcatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgttgatggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcatcgagcgggtcaccaccgcacgctacgacctgctagctcaggcccttgccccgctggcctgggactatgacctcatcttcatcgactccgggccggcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggatgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgccgaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagct

SEQ ID NO: 248 - DNA, 4896 bp, Propionibacterium acnes
gcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcagcggaagtgtcattgcaaccgtcggtggtcatccgccaacatttgctcacccaaatcagtctgggggacctgtcacatcgcggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcctcggccatgttccaggccatgcagtcgggtacaggcaccatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggctagggctgatcctggccatcgacgggctggtcccggcgccgcctcgacctggtgccccgctgagcccggcccaaaggtgggctcggctcacccaccgtcccactggtgcggccgggcgtcgccgggatttgcgttgggggttggctgttcttgtcggtgtcgtgctgtttgtgctcaccgggtgggtggctgcgctggcgctgggccccatcattgtgttgttggcccccaccctgctgggggcggccccaccgaccgatattccgctgatggaggcgctggatcgctgggtgcgtcaggtcgctgcggtgctgccacaggggcgcgacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgaacggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctagccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttacgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaacgacaccgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatgcgcggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgagtggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgcgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtga

SEQ ID NO: 249 - DNA, 4892 bp, Propionibacterium acnes
gataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcagcggaagtgtcattgcaaccgtcggtggtcatccgccaacatttgctcacccaaatcagtctgggggacctgtcacatcgcggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcctcggccatgttccaggccatgcagtcgggtacaggcaccatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggctagggctgatcctggccatcgacgggctggtcccggcgccgcctcgacctggtgccccgctgagcccggcccaaaggtgggctcggctcacccaccgtcccactggtgcggccgggcgtcgccgggatttgcgttgggggttggctgttcttgtcggtgtcgtgctgtttgtgctcaccgggtgggtggctgcgctggcgctgggccccatcattgtgttgttggcccccaccctgctgggggcggccccaccgaccgatattccgctgatggaggcgctggatcgctgggtgcgtcaggtcgctgcggtgctgccacaggggcgcgacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgaacggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctagccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttacgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaacgacaccgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaggctcagcgtgtcgtccatccggtcccggggtcggcacaggaggcagcctcgcagatcactagtcatggcggggtgcgtgatgcgcggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgagtggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgcgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggt

SEQ ID NO: 250 - DNA, 4617 bp, Propionibacterium acnes
gcgataccgcaaggctgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgaatgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcgggtctgtgggagacgatcatcacgtacccgttagatcgtcgccctgacaagatcgctgcgaacctcatcctcgacacgttgcaccgggttacccggttttggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcgtatcttctagcaattgatctagctatcatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgttgatggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcccggccctccacgagttcaccgaccccgcatccttagcggccatcctcgaccgagtcaccaccgcacgctacgacctgctagctcaggcccttgccccgctggcctgggactatgacctcatcttcatcgactccgggccggcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgactaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttacctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggtcggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagct

SEQ ID NO: 251 - DNA, 4613 bp, Propionibacterium acnes
gataccgcaaggctgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgaatgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcgggtctgtgggagacgatcatcacgtacccgttagatcgtcgccctgacaagatcgctgcgaacctcatcctcgacacgttgcaccgggttacccggttttggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaattgatctagctatcatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgttgatggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcccggccctccacgagttcaccgaccccgcatccttagcggccatcctcgaccgagtcaccaccgcacgctacgacctgctagctcaggcccttgccccgctggcctgggactatgacctcatcttcatcgactccgggccggcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgactaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttacctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcag

SEQ ID NO: 252 - DNA, 5053 bp, Propionibacterium acnes
tggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatctgtgcatcgatatacctatgtatctgtctgtggtttttagaggccactcccgtcgccccgggccgctcagcgataccgcaaggctgtgtgggatcagctgttccgctctcccgacatggcagacagcaccctgcggactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttatcttgatggccacggccaccaaggtgcgccgtactaatgacggcttcaatgatctgttggcgggtctgtgggagacgatcatcacgtacccgttggatcgtcgccctgacaagatcgctgcgaacctcatcctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcgtatcttctagcaattgatctagctatgtatatagctgatgatctagctaccatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcgctgctctcaacgagttcaccgaccccgcatccttagcggccatcctcgaccgagtcaccaccgcacgctacgacctgctagctcaggcccttgccccgctggcctgggactatgacctcatcttcatcgactccgggccggcacaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacctcggcaggcgggtcatccaccaccgggcagggcgccaccaataccgatattcaatcgtgggctgcgacgatggcgtccggcaccaaaagtactgagcaggtcaccttgatcaatgtggaggtggactcgcgtgatgcagctcggatcgcccagctgacatcgcagggccgtatcgctgtggtaaaggattcgactcgatgagcacaatcgttttgaccagtgtgtcgggagccccgggggtgaccacgacagcgattgggttggggcgggtctggccacagtccagtctggttgtcgaggacgacacccatcacgcgatgttggcgggctatctgcgagctgcccagcacgccgagccgaacttggccacggtggcaaatctgacggccactccgaccaatgcccaaaccgtgtgggaatccatcgccaggcctctgcccaccgatgatccggtcagcgggctgagacgcaaggccgtcctcggcccgcccacaccgtggtctcgtgcaggtatcgacccccggtggggattcatgctggccctgtggcggcagctggccgaggccgggatcgacaccatcatcgacctgggtcgcctagccacgccgctgacgtcaacgccacatctgatcgccacacccatcgtcgaggacgccgacatgatcctggtgatgatcgaggcgacgctacgcgatgtggccggcgcccacacgatggtcgaagggctggccgagcagatgaacctggccggggcccaccagcgcctcggactgttggtccaccgcggcggcgcggcccgcggggtcgctgagttcaccgacaaagagatcacgtcggcgttgcagctaccggtctgcgggtcgatagtccatgacccagtcgcggcagcccagctgtctgacggggtcgggcagcggttcgacaagtcgcgtct

SEQ ID NO: 253 - DNA, 4892 bp, Propionibacterium acnes
gataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacaccgatcacaccgatgtgacgatcatgcaccaacagaagttccgtatccacgcgatctcagcggaagtgtcattgcaaccgtcggtggtcatccgccaacatttgctcacccaaatcagtctgggggacctgtcacatcgcggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcctcggccatgttccaggccatgcagtcgggtacaggcaccatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggctagggctgatcctggccatcgacgggctggtcccggcgccgcctcgacctggtgccccgctgagcccggcccaaaggtgggctcggctcacccaccgtcccactggtgcggccgggcgtcgccgggatttgcgttgggggttggctgttcttgtcggtgtcgtgctgtttgtgctcaccgggtgggtggctgcgctggcgctgggccccatcattgtgttgttggcccccaccctgctgggggcggccccaccgaccgatattccgctgatggaggcgctggatcggtgggtgcgtcaggtcgctgcggtactgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgaacggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctagccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttacgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacaccgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaagctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggcggagcaagtctaagcgtcgaggtgctcatgtgggcgccgatcgcgctggtgatcatcgggtttgttgtgggtatcggccggatgtcgatggcccaggacgcggtgagtggcgcggctggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttggattcgggtcccggacggtgcacgcaacggggtctgccccggtagacacctatcgggaaaggagaggctgagatggcccgcgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgctggtggtgatagccggcttaccggccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggcccccgcttggcgcgccgagtggcagccggtctcctcattgccgcgttcgcgggcgcaccggcggccacgtcggcagctcacgcggtcgaggccacccatgtggcggtcgcagctcaggcttccccggcccacgcggccggcacccaggacagccccgccaccacctctcaggccccggacgcctccaccactccgaaaatctggaagacctacacggtgcgggccaacgactacctgtggaagatcgccgagcactactacggt

SEQ ID NO: 254 - DNA, 4611 bp, Propionibacterium acnes
gcgataccgcaaggctgtgtgggatcagctgtgccgctcccccggcatgacaggcggcgccccacagattgacgacactgcggggctgcggaggtctcccgcggcgtccgctggggcgagtgcatgcctgtcagctcatcttttatcgtcatgtttccccttgtcagagcggtttttgcaaagtgacaacgtcaggggtcttgacgacaacatcctcgacaacatcgtggcggtggtctgtgtcttgtcagttcaacgcaccggggaaagaggcaccgctgatgttcaccaccacagctaccctcaacgatgaatgggaccagattcgcgccatcgagatcgattggcatgactgccccgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcggggttgtgggagacgatcatcacgtacccgttggatcgtcgccctgacaagatcgctgcgaacctcaccctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatcctctcttgctcatgcctgccgccaccctacccctacctgctagaaacatagccatgtctccagcaacgcatctagcatatcttctagcaattgatctagctatgtatatagctgatgatctagctatcatatagctgtgtctccagcgcaaatgacagcccaatagcatgcttgccacaggaaggtgcgtcagcctcccgaaatactggaaggagctttaccgtgcaggacatgacctcgaccagaccgattgaccgatccccgttcgaccgcactattgcggtgtggaaccacaagggcggcacgttcaagacgtccgtcgtggcgaacctgggatacctgttcgccgccggtggcaacaaggtgctgctggtcgacatggacccccaagccaatctcgacattgacttcggtatacccgcgggagaacgtgaacggggcatgggattagccgaggcgctacgtgaggggacggcccttcccccaccgcagcatctcagcgagaaccttcacctggtcagtggcggcgctgctctcaacgagttcaccgaccccgcatccttagcggccatcctcgagcgggtcaccaccgagcgctacgacctgctagctcaggcccttgccccgctggcctgggactatgacctcatcttcatcgactccgggcctgcccaaactctgctgtcccagaccatccttggagtagcccgctggctggtagtgcccacccgcaccgataacgcctcaatcactggcctcgtcgacgttcaagacgccatcgacggggttgcctcctgtaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaagcccagaagacccccaccagccagcctggccgtcaacggatcaacgtcaccgtctacgttgtgcccgaactccatgagcggctgcgctcccgatcggcggcgacgggagtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcccaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgacggccagttttgctgataatccgttcgacaagctgcgctcccaggatgcggcaagagcttcggtagagcaggagcctgatgccggattagcgtcggagttgttttcggcgtcgtcggggtgggccagctctcagcaggtgtcccaagctcaaccggtgatgacccgttcggagaacgtggattggccggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagct

SEQ ID NO: 255 - DNA, 4345 bp, Propionibacterium acnes
ccggacagatccctatcggagaccttgctgtcgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagcaggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcagctgttcgggatggggcggttgcagccgctgttcgaaatcagcgacgccgaaaacatcatcgtggtgggtaaccatgaggtggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcttcggaggtgtcgttgcaaccgtcggtggtcatccgccaacatttgctcacccaaatcagtctgggggacctgtcccagcggggaatgatgccggtggaagtggcccggttcctcgatgaggcggtacaagctggcaagtccatcgtggtcgccggcgagcagggggcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcttcggccatgttccaggctatgcagtcggggactggcactatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactgatgaacaccccagcgctgatagcagccctcatcgtgaccggcctgggactgatcatggccatcaacggcctgatcccggccacacccaaacccggcaccacgctgacgctgtcacagcggtgggcccgggccacccaccgcccagccggggcagccgggcgccgacgcgacctgcgctgggcgctggccggtctcgtcggcatcgtgctgttcgtcctcacaggttgggtcgctgccctggccctgggccccatcaccgtgctgctagcacccaccctgctgggggcggccccaccgaccgatattccgctgatggaggcgttggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttgcgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacatcgtgtcgagc

SEQ ID NO: 256 - DNA, 4249 bp, Propionibacterium acnes
gacgccggccaccccaactactccgacccacacggtgaccccagctccggcctctgccggccactcgaccagcgacgagcacccactccatacggataccgccgcagcggacaaggccagcaacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagctcagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccaggttcgcgtcgacaccaaccaacccggcaccgacacccccttccccatcgacgacatcgacccgctgagctccgaccatccggtcctatccatcatcggccaccccgacatcacaggtgccactggaaccgttgggcgctccccgtggcgctgccaacagttggctctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggggacctggggctggcccggtgggcgttgacccaagggctactggtgtctcccgatcatgaggacctggtcaccggttgtctgcgcaccgagtaccaggccggcaacatggacaaggtttccgagctggtcgatcacctgtcggctaccgcacgacgcctgggcgtcgatttgagcgccgacaccacccggatcatcgactccgttattacccatacacgcaggagagcatcatgatctcccgttgcactcatctccgtcaggaaggttcctatgcaccattatcgtcttggtatcggcactgccctcatcgcggtagcagccgtggccggctgtcgctcaacagactcgacacccacaccacctccatcccgtgtctccgccacgacatcagcgagctctaccctcagcccgaccccgtcagccggagcgatcagtgccgccgacgccgaaaacatctaccgcaccgtccaagctaacaagatcgcactgtacaaaaagggtggcctggcacccggggaacccgcacccgcgacactgtcgaactacgccaccggccaggctctcaccgactacatgacctacatgcaccaaatctcggggcagggcatcaaaatcacatcggggaactcctcggttaccgcggtgcgggagaaaaagggtgataccacctaccccgaagccgctatcgccttggaatcgtgcgaagacgacagttcgattcgtaccgtggaccgccacggaaaggctgatcatggacgcattttccatgtcgacagttggtatgcccgcgataagaagggcaccgtcaagatgatcgcattcaactcaacggaggtccccacatgcgacgtcaagtaatcaccgcggccgtactgggcctggccctggccaccacctccctgcccgccctcgcaggcggcggcgacttgaacggcagtgtggacacggatggccctggttacgatgtgcgtactgaggtggattaccatcacaccaccggtggtgcgggtgggggtgccacgacagggggccatcatgggggcaaaacccacggtgatggtgaaggtgaggctattgatgggcgttctcgcgccgatgccgaagccgaactagacgaagccgaccgtaaccaggacttgacttgtgatgtcttgctcccaccggcgccgaataccccagccggccaggaatgggcgaaagaatgcaatcccccagcgaaaaaggggcagaaggccaccccgaagcccgatccggtgttagtgggccgtcacgcggccttgcagctcacccttcccggcgcggcccctcgtatcgatccgtcccccgaccttaaccggtggcactcggcagcagtgggccaggctttgtggttgtcggttgatgaccccaccgccactacgcagaaatcgatcacgtttatgggccaggttgtctcgttgagcgccaaacgtaacggtttgtcgtttgatatgggtgatggtcatgtcgtgcactgtgatgccacgacgacatggacggagtcggtggaaccggggaccccctcacccacgtgcggttacacctaccaacaggcagccccggccgggggctataaggtcaccgcaatcacgtcgtgggatgtgacctggtcggtactaggacacacgggcacagtccacatccagaaggccggtgggcagatgcttccggtcggcgagttggagtctgttgttacacggcgatgactcctgatagtccgacgctgtatgaggtgttggaggtctgccctgatgccactgatgaccagatcaagacggcgtggcgtcgtgccgcgaaagtgactcaccctgatgccggtggcactagtgaggcgttcgcggccgcccggcacgcctgggaggtgttgtctgatcctgcccggcgcaccgcctacgatgccgacctggcgggggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcggtgacgggtctggcatttttcaccatggcggccatctggtgtggatggtcgttgataggtggtgcgttgctgtggggccagacgtc

SEQ ID NO: 257 - DNA, 1918 bp, Propionibacterium acnes
aaccgtcatctggcgtggagtagcgagctgatgcaggaaggcaatttgtacggccttcccgaggaagacccgttgtggggcgaggccgtggagctggtagcgggacttatcccctctgtgcgggcgatgtggtcgcacgatgggcagaccgtgactgtgtcggctggccggcgggtggcgacactggggatgccgatgcggggatggcgtggtatcgagatgcgcggctggaatccagtgggcgccgatacgtggtggatcgttgaccaggtgggtagttggctggtcgatcaggatgagccgatggtcgttgacgggagggtgctccatgaggcgtgggaacggtcgcagatggtccgttcaggccgctgagaaaaaatttaggtccgccctgcatatcggggcctcttcataccttcaaaagtgtgaagggaatacagactcttcgactggaattaaaatggtatatggcgtgtccggtccgcacccagctccacgatgcgccataggggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgacgtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaaggttctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcggg

SEQ ID NO: 258 - DNA, 4029 bp, Propionibacterium acnes
gacgatcatcacgtacccgttagatcgtcgccctgacaagatcgctgcgaacctcatcctcgacacgttgcaccgggttacccggttttggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcgtatcttctagcaattgatctagctatcatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgttgatggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcccggccctccacgagttcaccgaccccgcatccttagcggccatcctcgaccgagtcaccaccgcacgctacgacctgctagctcaggcccttgccccgctggcctgggactatgacctcatcttcatcgactccgggccggcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgactaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttacctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggtcggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcag

SEQ ID NO: 259 - DNA, 4013 bp, Propionibacterium acnes
acccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgagacctggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggagtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaaacatacgctggcaagccgttgcatgagacgacgcctccgcccgccacaccaacggtcaccgccacggccacggtgacggtgaccgtg

SEQ ID NO: 260 - DNA, 3969 bp, Propionibacterium acnes
gacgatcatcacgtacccgttagatcgtcgccctgacaagatcgctgcgaacctcatcctcgacacgttgcaccgggttacccggttttggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaattgatctagctaccatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgttgatggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcccggccctccacgagttcaccgaccccgcatccttagcggccatcctcgaccgagtcaccaccgcacgctacgacctgctagctcaggcccttgccccgctggcctgggactatgacctcatcttcatcgactccgggccggcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgactaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttacctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccggccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgat

SEQ ID NO: 261 - DNA, 4012 bp, Propionibacterium acnes
acccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgagacctggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggagtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagccccgcgcgccgcagtcgcgcctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcaggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagccgttgcatgagacgacgcctccgcccgccacaccaacggtcaccgccacggccacggtgaccgtgaccgtg

SEQ ID NO: 262 - DNA, 811 bp, Propionibacterium acnes
attttgtccacccacccctgtcgattttgtccgccaagtattagacaaaccattagacagtgaattagaccctgggtcgcgtcagcgtgttagctcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcagttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggacgtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcaccgcgatgtgccaaatcgtgcgcaccgccctggaggccgacctggccgccggaacccggtgggaggaccgatgaggg

SEQ ID NO: 263 - DNA, 3790 bp, Propionibacterium acnes
tagccgacacggcggaccgtgcccctgacagtaagcggcactactggagacatcaccatgaccgctcagatcctcgccccgtgcaaccagaaggctgccgtcatcgaaggagccctgccatgaaccaacctaccccccacaaggccgacgagtcacagacgagcaacaccacgaggaagtggcggcacaaggtgtcgttctaccaagacccggccgacaccgaccgagtccgcggagcgatcctccacaccatgacaaccgaaggcaaccggaacctgagccagttcgtcaacgatgccgtcatggccaaggtgaccgaactggaagcaaaatacaaccacggcgagccattccccgccgtgggagcccgaggactcccccagggcggcgcagccgccaacagataagagggcggggaccaccaatagcagtcgatttcggatccagatcgggtagacaggacccatgatgaatttcatatcctccctgctctcggccatcctgaccctctttgcgatggtagccgtggcgataggagtggtgaacattgtgccgggaatatgcgccatcatcggtgcacggaaatacggcgaccaggaccgtgtgcgggcaggacaacgaaagatccttcttggtgctatcgccttggtggtagcagtaggcattcacccgtgacccacggttaccggaagccccgccgcaatcgataccactgtcagtaccatcaggggcgataggggtcaagctctccttgtcacaatcccttccccggcagcccagtaaccgtcgcttacagccatacatggatatgcgcccattcgtcggcaccgacgccgtgcgggttggcgacgctgacccgtctgctcacaaacgacccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgaggccaggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtaaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcagtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttg

SEQ ID NO: 264 - DNA, 3861 bp, Propionibacterium acnes
gctgagaaaaattttgggtccgccctgcatatcggggcctcttcataccttcaaaagtgtgaaggggaatacagactcttcgactggaattaaaatggtatatggcgtgtccgggccgcacccagctccacgatgcgccataggggagccataacttcaccaatcgtatacgatatgagtgtgggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcggtgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggattggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagatgcgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagacctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgaggcgtcctcccggagggcgtcatgaccgctttaattcaagctctgccgacagctgaactgtctgctggacctggtgctagcggtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctatgtccatcgtggctcggttcctgggctgttcttcgcgccaggtctctcatatccgtggggctctcgttgatgccggtctgctcggctgtgacgaggtgtcgggggcggcgagccgggtgtggttcccctcgatggccgaggagtgtgcagcggatcgtgaggtggtcgatggggccgtcgtcggtgctggggtgggctctggtgaaggtgtcgaggagggcggggaacccctgtcgattttgtccacccacccctg

SEQ ID NO: 265 - DNA, 2093 bp, Propionibacterium acnes
caggtgggtttgaccgccagcgtcggattggtgctggtcgctgggctgatcaccactctcaaccgtcgttaccggacccggttcacccgccagccccgcggcaaggccatgaccctgcccagcccggacgcccaaactgccgagatagcgctgcgcagcaccagagcagccgagactctgacgatcacctgcctcgaccacgcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgtgactggtccgacgaggtcaacgtcaccctggtcggccaggtgtgcccgggcctagaagacgcactagagtctccgaccctgacccgcgccaccgacgtggacgccctcctcaccaccctggaagctcgcgccgacgaccagcgacacatcctcaccgaaggaagccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccacacgaatggtccctcaccctgacaggtgacccactagccgccgacgtggctcccctcggctggcacatccacccccaaaccctctcccccgacctgtacaaccgcgtggttgaactactcgccaactccgccgccgcagactacgaacccgccagctggtggaaccacgacgccgacgacgagcccaccaccggccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgacgaggccaccgaccaggttcgtgtcgacaccgaccaacccggcaccgacacccccttccccatcgacgacatcgacccgctgagctccgaccacccggtcctatccatcatcggccaccccgacatcacaggtgccactggaaccgttgggcgctccccgtggcgctgccaacagttggccctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgaatcggaacttcgccagttcagggcgtcgatgtaccacgtggaggcccgcatcgtcgatgctgccctccaagtgacagaccgggccctggaagccggggacctggggctggcccggtgggcgttgacccaagggctactggtgtctcccgatcatgaggacctggtcgccggttgtctgcgcaccgagtaccaggccggcaacatggacaaggtcgccgagctggtcgatcacctgtcggctaccgcacgccgactgggcgtcgacctcaacgaggacaccacccggatcatcgatacggtcacccacgccgacaggagagcatcatgatctcccctgcactcatctccgtcaggaaggttcctatgcaccat

SEQ ID NO: 266 - DNA, 650 bp, Propionibacterium acnes
tgcgggtacacctaccagcaggcagccccggaaggcggttataaggtcaccgcaatcacgtcgtgggatgtgacctggtcggtactaggacacacgggcacagtccacatccagaaggccggtgggcagatgcttccggtcggcgagttggagtctgttgttacacggcgatgactcctgatagtccgacgctgtatgaggtgttgggggtctgccctgataccactgatgaccagatcaagacggcgtggcgtcgtgccgcgaaagtgactcaccctgatgccggtggcactagtgaggcgttcgcggccgcccggcacgcctgggaggtgttgtctgatcctgcccggcgcaccgcctacgatgccgacctggcggaggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcg

SEQ ID NO: 267 - DNA, 3863 bp, Propionibacterium acnes
gctgagaaaaattttgggtccgccctgcatatcggggcctcttcataccttcaaaagtgtgaaggggaatacagactcttcgactggaattaaaatggtatatggcgtgtccggtccgcacccagctccacgatgcgccataggggagccataacttcaccaatcgtatacgatatgagtgtgggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggattggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagacccgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagacctagaagatccaaaagaaccggtttcggctgttgcttcggtcttcatggtagctgatagcccgcgtcgttggaagtgcgacgacgccgatcctcatcggtatcgcaccctgaaacagggtgttgaacatgaagggttgaccgctatgtcaagccatgagacgccctcccggagggcgtcatgaccgctttaattcaagctctgccgacagctgaactgtctgctggacctggtgctagcagtccagctagaccctctgctgagggcttcatcaagattcatcacgacctcattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggagagacgtcgggagagtgggtgaggcattggctggtgtggcggatgctggccggtcgtactggtgtggctcaggcccctacgtccatcgtggcccggttcctgggctgttcttcgcgccaggtctctcatatccgtggggctctcgttgatgccggtctgctcggctgtgacgaggtgtcgggggcggcgagccgggtgtggttcccctcgatggccgaggagtgtgcagcggatcgtgaggtggtcgatggggccgtcgtcggtgctggggtgggctctggtgaaggtgtcgaggagggcggggaacccctgtcgattttgtccacccacccctgtc

SEQ ID NO: 268 - DNA, 653 bp, Propionibacterium acnes
acgtgcgggtacacctaccagcaggcagcaccagcggggggctataaggtcaccgcaatcacgtcgtgggatgtgacctggtcggtactaggacacacgggcacagtccacatccagaaggccggtgggcagatgcttccggtcggcgagttggagtctgttgttacacggcgatgactcctgatagtccgacgctgtatgaggtgttgggggtctgccctgatgccactgatgaccagatcaagacggcgtggcgtcgtgccgcgaaagtgactcaccctgatgccggtggcactagtgaggcgttcgcggccgcccggcacgcctgggaggtgttgtctgatcctgcccggcgcaccgcctacgatgccgacctggcgggggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcg

SEQ ID NO: 269 - DNA, 3862 bp, Propionibacterium acnes
gctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggattggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgaccgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagacccgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagacctagaagatccaaaagaaccggtttcggctgttgcttcggtcttcatggtagctgatagcccgcgtcgttggaagtgcgacgacgccgatcctcatcggtatcgcaccctgaaacagggtgttgaacatgaagggttgaccgctatgtcaagccatgagacgccctcccggagggcgtcatgacctctttaattcaagctctgccgacagctgaactgtctgctggacctggtgctagcagtccagctagaccctctgctgagggcttcatcaagattcatcacgacctcattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctatgtccatcgtggctcggttcctgggctgttcttcgcgccaggtctctcatatccgtggggctctcgttgatgccggtctgctcggctgtgacgaggtgtcgggggcggcgagccgggtgtggttcccctcgatggccgaggagtgtgcagcggatcgtgaggtggttgatggggccgtcgtcgatgctggggtgggctctggtgaaggtgtcgaggagggcggggaacccctgtcgattttgtccacccacccctgtc

SEQ ID NO: 270 - DNA, 2238 bp, Propionibacterium acnes
gacgccggccaccccaactactccgacccacacggtgaccccagctccggcctctgccggccactcgaccagcgacgagcacccactccatacggataccgccgcagcggacaaggccagcaacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaagccctcgacaacaccgaccagaccaccaaccaggttcgcgtcgacaccgaccaacccggcaccgacacccccttccccatcgacgacatcgacccgctgagctccgaccacccggtcctatccatcatcggccacccccacatcacaggtgccactggaaccgttgggcgctccccgtggcgctgccaacagttggccctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggagacttggggctggcccggtgggcgttgacccaagggctactggtgtctcccgatcatgaggacctggtcgccggttgtctgcgcaccgagtaccaggccggcaacatggacaaggtcgccgagctggtcgatcacctgtcggctaccgcacgccgactgggcgtcgacctcaacgaggacaccacccggatcatcgatacggtcacccacgccgacaggagagcatcatgatctcccctgcactcatctccgtcaggaaggttcctatgcaccat

SEQ ID NO: 271 - DNA, 739 bp, Propionibacterium acnes
acgtgcgggtacacctaccagcaggcagcaccagcggggggctataaggtcaccgcaatcacgtcgtgggatgtgacctggtcggtactaggacacacgggcacagtccatatcgagaaggccggtgggcagatgcttccggtcggcgagttggagtctgttgttacacggcgatgactcctgatagtccgacgctgtatgaggtgttgggggtctgccctgatgccactgatgaccagatcaagacggcgtggcgtcgtgccgcgaaagtgactcaccctgatgccggtggcactagtgaggcgttcgcggccgcccggcacgcctgggaggtgttgtctgatcctgcccggcgcaccgcctacgatgccgacctggcgggggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcggtgacgggtctggcatttttcaccatggcggccatctggtgtggatggtcgttgataggtggtgcgttgctgtggggccagacgtc

SEQ ID NO: 272 - DNA, 3863 bp, Propionibacterium acnes
gctgagaaaaattttgggtccgccctgcatatcggggcctcttcataccttcaaaagtgtgaaggggaatacagactcttcgactggaattaaaatggtatatggcgtgtccggtccgcacccagctccacgatgcgccatagaggagccataacttcaccaatcgtatacgatatgagtgtgggtgagcatctaccggtggccgacagtcagatacaagcatgggcggatgaagcagaagctgattatgacctgagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcggggagggcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatctcgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagacccgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagatctagaagatccaaaagaaccggtttcggctgttgcttcggtcttcatggtagctgatagcccgcgtcgttggaagtgcgacgacgccgatcctcatcggtatcgcaccctgaaacagggtgttgaacatgaagggttgaccgctatgtcaagtcatgagacgccctcccggagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggctcggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcggtgctggggtgggctctggtgaaggtgtcgaggagggcggggaacccctgtcgattttgtccacccacccctgtc

SEQ ID NO: 273 - DNA, 2238 bp, Propionibacterium acnes; identical to SEQ ID NO: 215

SEQ ID NO: 274 - DNA, 3865 bp, Propionibacterium acnes
gctgagaaaaattttgggtccgccctgcatatcggggcctcttcataccttcaaaagtgtgaaggggaatacagactcttcgactggaattaaaatggtatatggcgtgtccggtccgcacccagctccacgatgcgccatagaggagccataacttcaccaatcgtatacgatatgagtgtgggtgagcatctaccggtggccgacagtcagatacaagcatgggcggatgaagcagaagctgattatgacctgagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaaaattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcggggaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatctcgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagacccgccggaaggggacacgcggcccgaaacctcgcagcgacgaggagctaacggctgtgatgttccgcgtcccagagtcagtggccgaacgtgtcagcgatatggctttggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagatctagaagatccaaaagaaccggtttcggctgttgcttcggtcttcatggtagctgatagcccgcgtcgttggaagtgcgacgacgccgatcctcatcggtatcgcaccctgaaacagggtgttgaacatgaagggttgaccgctatgtcaagtcatgagacgccctcccggagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggctcggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcggtgctggggtgggctctggtgaaggtgtcgaggagggcggggaacccctgtcgattttgtccacccacccctgtcga

SEQ ID NO: 275 - DNA, 3865 bp, Propionibacterium acnes
gctgagaaaaattttgggtccgccctgcatatcggggcctcttcataccttcaaaagtgtgaaggggaatacagactcttcgactggaattaaaatggtatatgccgtgtccggtccgcacccagctccacgatgcgccataggggagccataacttcaccaatcgtatacgatatgagtgtgggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcggtgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggattggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacgcctaacaacaactttgtttcatgatttggcgcgtcggaccctttctgaccgatgtcgtgcgcaacaatggacccatgagttcgcctaccaagatgcgccggaagggaacacgcggcccgaaacctcgcagcgacgaggagctaacggctgtgatgtgccgcatcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcactgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagacctagaagatccaaaagaaccggtttcagcttttgcttcggtcttcatggtagctgatagcccgcgtcgttggaagtgcgacgacgccgatcctcatcggtatcgcaccctgaaacagggtgttgaacatgaagggttgaccgctatgtcaagccatgagacgccctcccggagggcgtcatgaccgctttaattcaagctctgccgacagctgaactgtctgctggacctggtgctagcagtccagctagaccctctgctgagggcttcatcaagattcatcacgacctcattagtgcgggcgtgtcggggaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgaccatcgtggcccggttcctgggctgttcttcgcgccaggtctcccatatccgtggggctctcgttgatgccggtctgctcggctgtgacgaggtgtcgggggcggcgagccgggtgtggttcccctcgatggccgaggagtgtgcagcggatcgtgaggtggtcgatggggccgtcgtcgatgctgaggtgggctctggtgaaggtgtcgaggagggcggggaacccctgtcgattttgtccacccacccctgtcga

SEQ ID NO: 276 - DNA, 2889 bp, Propionibacterium acnes
aggcgagcccgccctagtatccgcctgaccaccctgaccggcggcatcgacctatccagcgtcgacatcgacgacatcatcgacgaagccaaccaggccctcgacaacaccgacgaggccaccgaccaggttcgtgtcgacgccgaccaacccggcaccgacacccccttccccatcgacgacatcgacccgctgagctccgaccatccggtcctatccatcatcggccaccccgacatcacaggtgccactggaaccgttgggcgctccccgtggcgctgccaacagttggctctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacttgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggggacctggggctggcccggtgggcgttgacccaagggctactggtgtctcccgatcatgaggacctggtcgccggttgtctgcgcaccgagtaccaggccggcaacatggacaaggtatccgaactggtcgatcacctgtcggctaccgcacgacgcctgggcgtcgatttgagcgccgacaccacccggatcatcgactccgttattacccatacacgcaggagagcatcatgatctcttctgcactcagctctgtcaggaaggttcctatgcaccattatcgtcttggtatcggcactgccctcatcgcggtagcagccgtggccggctgtcgctcaacagactcgacacccacaccacctccatcccgtgtctccgccacgacatcagcgagctctaccctcagcccgaccccgtcagccggagcgatcagtgccgccgacgccgaaaacatctaccgcaccgtccaagctaacaagatcgcactgtacaaaaagggtggcctggcacccggggaacccgcacccgcgacactgtcgaactacgccaccggccaggctctcaccgactacatgacctacatgcaccaaatctcggggcagggcatcaaaatcacatcggggaactcctcggttaccgcggtgcgggagaaaaagggtgataccacctaccccgaagccgctatcgccttggaatcgtgcgaagacgacagttcgattcgtaccgtggaccgccacggaaaggctgatcatggacgcattttccatgtcgacagttggtatgcccgcgataagaagggcaccgtcaagatgatcgcattcaactcaacggaggtccccacatgcgacgtcaagtaatcaccgcggccgtactgggcctggccctggccaccacctccctgcccgccctcgcaggcggcggcgacttgaacggcagtgtggacacggatggtcctggttacgatgtgcgtactgaggtggattaccatcacaccaccggtggtgcgggtgggggtgccacgacagggggccatcatgggggcaaaacccacggtgatggtgaaggtgaggctattgatgggcgttctcgcgccgatgccgaagccgaactagacgaagccgaccgtaaccaggacttgacttgtgatgtcttgctcccaccggcgccgaataccccagccggccaggaatgggcgaaagaatgcaatcccccagcgaaaaaggggcagaaggccaccccgaagcccgatccggtgttagtgggccgtcacgcggccttgcagctcacccttcccggcgcggcccctcgtatcgatccgtcccccgaccttaaccggtggcactcggcagcagtgggccaggctttgtggttgtcggttgatgaccccaccgccactacgcagaaatcgatcacgtttatgggccaggttgtctctttgagcgccaaacgtaacggtttgtcgtttgatatgggtgatggtcatgtcgtgcactgtgatgccacgacgacatggacggagtcggtggaaccggggaccccctcacccacgtgcggttacacctaccaacaggcagccccggccgggggctataaggtcaccgcgatcacttcgtgggatgtgacctggtcggtactaggacacacgggcacagtgcatgttgagaaagccggtgggcagatgcttccggtcggcgagttggagtcagttgtcacccgccgatgaaccccgatagccccaccctctacgaggtattgggggttacccccgacgccaccgacacccagctcaagacggcatggcgcactgctgcgaaagcgacccaccccgatgccggcggcgacccccaggcgttcacggccgcccggcacgcctgggaggtgttgtctgatcctgcccggcgcaccgcctacgatgccgacctggcgggggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcg

SEQ ID NO: 277 - DNA, 1224 bp, Propionibacterium acnes
gacgccggccaccccaactactccgacccacacggtgaccccagctccggcctctgccggccactcgaccagcgacgagcacccaatccatacggataccgccacagcggacaaggccagcgacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgctgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgtgactggtccgacgaagtcaacgtcaccctcgtcggccaggtgtgcccgggcctagaagacgcactagagtctccgaccctgacccgcgccaccgacgtcgacgccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgggtgtcggtggccgcggtaacaaccagccccaccagcccagacgaatggtccctcaccctgacaggtgacccactagccgccgacgtggctcccctcggctggcacatccacccccaaaccctctcccccgacctgtacaaccgcgtggttgaactactcgccaactccgcagccgcagactacgaacccgccgactggtgggaccatgacgccga

SEQ ID NO: 278 - DNA, 3861 bp, Propionibacterium acnes
gctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggattggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactatccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaagggcggggtgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcactattgacgggaaagtcctgttcgagacctgggacgggctgcaggcagcccgtcctcacagctgagaaaaaattttggggccgttccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagatgcgccggaagggaacacgcggcccgaaacctcgcagcgacgaggagctaacggctgtgatgtgccgcatcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcactgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagacctagaagatccaaaagaaccggtttcagcttttgcttcggtcttcatggtagctgatagcccgcgtcattggaagtgcgacgacgccgatcctcatcggtatcgcaccctgaaacagggtgttgaacatgaagggttgaccgctatgtcaagccatgagacgccctcccggagggcgtcatgaccgctttaattcaagctctgccgacagctgaactgtctgctggacctggtgctagcagtccagctagaccctctgctgagggcttcatcaagattcatcacgacctcattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggcccggttcctgggctgttcttcgcgccaggtctctcatatccgtggggctctcgttgatgccggtctgctcggctgtgacgaggtgtcgggggcggcgagccgggtgtggttcccctcgatggccgaggagtgtgcagcggatcgtgaggtggtcgatggggccgtcgtcggtgctgaggtgggctctggtgaaggtgtcgaggagggcggggaacccctgtcgattttgtccacccacccctgtc

SEQ ID NO: 279 - DNA, 3714 bp, Propionibacterium acnes
cgattttgtccacccacccctgtcgattttgtccgccaagtattagacaaaccattagacagtgaattagaccctgggtcgcgtcagcgtgttagctcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcggttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccaccaggcccgagacaccctcacccacgacaacccccatgaacgccgcctggcccgcgaacaccaccgcgcccaactcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacacacaccatgaaacacgacaagccacctgacagtatcagctgcaagacgcatgacaacatagaaggacatgatgaaatacacatagacacaaccccgcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaaaccgacccattcgcccgccagaaagcagcagaagaccgcgcccaccaactccaagacgaagcccaacgccacgcccaccccaaacgcgtcatcggccccaccgcacgattccagttcgtcctgccagccgacgtgctcaccggcctcaaacacctcgccctcacccgcggcaccaccgcccgccaactcaccctcgacgccctcgacaccgcctacggcctcgacaccctcgccaacagcgggaagaaaacccacccatgacccgtgggtccccctgccaccaccccctcgacggcaactgtgtgcgagccacaggcccgcacacaggcggcagcccagtgccgtccccgccaggaaaggaactgaacttttctggagtgctggctccctatcaccccttatggtgctatcagatccagtagcgccagcccgagaggaaacccatgagctacatcgtccgcaccggaaatctagccggcacccccgagctgcgcgaggggtagccgacacggcggaccgtgcccctgacagtaagcggcactactggagacatcaccatgaccgctcagatcctcgccccgtgcaaccagaaggctgccgtcatcgaaggagccctgccatgaaccaacctaccccccacaaggccgacgagtcacagacgagcaacaccacgaggaagtggcggcacaaggtgtcgttctaccaagacccggccgacaccgaccgagtccgcggagcgatcctccacaccatgacaaccgaaggcaaccggaacctgagccagttcgtcaacgatgccgtcatggccaaggtgaccgaactggaagcaaaatacaaccacggcgagccattccccgccgtgggagcccgaggactccccccagggcggcgcagtcgccaacagataagagggcggggaccaccaatagcagtcgatttcggatctagatcgggtagacaggacccatgatgaatttcatatcctccctgctctcggccatcctgaccctctttgcgatggtagccgtggcgataggagtggtgaacattgtgccgggaatatgcgccatcatcggtgcacggaaatacggcgaccaggaccgtgtgcgggcaggacaacgaaagatccttcttggtgctatcgccttggtggtagcagtaggcattc

SEQ ID NO: 280 - DNA, 3907 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggttcttgtctgcccagcgtttctcggcgatgtcgatcatgtcttggatggttttgacccatcctcggatgggatcgactttggtcagtttgatccctccaaggaactcgatgggcttagtaacgggcccgtcaggaccgaattcggtgtcccagccttcgtcgatggctagtttcagttcggcggcgtcaacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgtgagcttcggtggcgctgagcagagtggcgggtgcggcaccgatctctccggtcactgatccggcatacatgaatcggccgtcgatgtacacgaagttagggatagggccggcaggcacggtggggcgccaaccttgttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgccgcccccctagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcggtagctgggcatgtcaccctcccctatctgtcaaatgagctagacacagtgtctatttaatttgacgcaaagtcaagtgcattagacgcctttgtgtggatccgccccaccagacaaacactcgcgcctcatgacccgccgcgaagccttaacgaaaccaaaccgcttatagaaccgctccgcagcgctccccgagggctttagctccaaggtaagaccttgctcgtcggcccattggcagacttgtgtgaggatctgtgagccgtagccctgatttcggggggcggcatgcacgcacatcagcatgtgaccatgacggcgggtcggcgggctgacataagccccaccacgccagtccggtgtgatctgccaacttcgccatgccgcagcgcgccagcggcgggcctcggtagccaccatgatcaccatgatgatggacagggttacgacgccgactatggtcagctcactccagccaggccagttcccggagatgatccagcctcccagcgcccagatgatcatggcttccacgcccgccgcaatcgggacgagtggggcagtacggatgcggcctgccatgatctcggtgatctcgctgcgatgccatgacaaggagaattcccacgactcttgaatcatgctgatgtgtgaacggcttcctcggcttcgccctgccatagcttctctagacggcgctcggctagctcgtcggggcacggcgacagcctgccgcactcggagcagaccccgaagtggcgcgagagagtgatgaccggctcatcgggagcatgaaccgattcaacgaccgggtgctgctcatcggtgagtcctgaggcgtgaccaatctcggctagacggaggtgaaccataccgtcgtagtagtcgaggccttcaacgtggaacgggtaggagccgtccgcggtgtggcctgcaaccaggtccccgacttccagctgactggcggtcatggttcgcaccggcggcagcggggtccgggtcgcgttgatcctcatggtctctccttgcttctgcgccttcatagatgaaggtgccacagccggggttgatgtgcggaaccacagccactttttcaataaatccatcaccacggtctcaccccttcccaaatgtgtaaaccgtggtttacgctttaaggcatgatcgaacacacaccgacacccgccgcgcctcgcgtggccatcatttcccctagcgggccaccacggttcttggccgagcctcccagcgccgcgctgcgacgccatggtcggacccgcatgaggtcccttcccctatcccctcacattcgcgcctgggtctccaccagcggccgcaaacccaatcccgtgactactgctttgatctggatgcacaccggggccctgcttttggtgtgggacatcgccgttttgaccggccccgccctcggccactgcgtatgccctctcagtaatagcgccgagctgactgcccggcgctggctcgaccaggtcgccgacaatcccggcttcctcaacacccttaccgaggctgcccgcatcaccgatgaatggcgtcacgcaacgcctccgcacattcaagccccttaccggacccttcatcagtgaacggaggtcatgcatgactagcaatattgaatggggccacaatcccgacggccgcgccgaggctcctctttaccgagcctgggccaagatgctcgtgcgcgcctccgggctaccctggcgtatcgtcgccgccctagccgggatctcccctacttccatgcaccaacttctgttcggccgcaacggtcgacccgtggaatggatcggctccgatgatgctcgcgccctgatggatatcggcatcgatgatctcgcctcagcgtccaccgaccgtatcccggcccgcgaatcccgcgagctgttggtagccctgcacaccctcggctggaccgatgagcatctaagccgctggctgaccagttccgacctcgacctgaccaccgcccccaaagccctctacgtcactcgactatccgccgcccgcatccaggccacttacgacctgctcgtcagccaacccgtccg

SEQ ID NO: 281 - DNA, 2174 bp, Propionibacterium acnes
ccccaatgcccccacaacgatcagcacaccaacagcgatcatcaggtgggcagcactaactgatcccaacgaaccaagatcaaacaagccctgcccgggagcgccgagcagtccgtgggcgcgaagccatgctccgagattgccaataatcttggggaccatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgtcttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgccttgccttcttgcccgtggcgcttccgagatggggtcagtgggcgatggctaggccgacgagggcgccgctgcacaggctgggtgcccaggggaggaatcgggtggtgtggtgtcggaaccggtcgattagggcatatagggcgatcagggtgaggccggctatgacagtgacctggatcgtgtcgatgccggttgctgcggccggggctgcccacagtggtgtgatgcgcacgtcggagaagccgaagccgcctcgggagatgagccaggcgatcatccacgccgcggagatgacgacagtagcgatagcagcacgtatcgccgcagtatggtccgagagggcggtaacgactacagccccgatccatccggcccatccggtccacgctaggactgccggtatccatgtggtgatggcgtcaatgacggcaacccatgccccgatggtggctagcagggcccacgtcggccacgtgggtgctggggcccatgctgtggcggtgatcatggtgagtgctgctgcgctacagaccgcgatcaagcttcggaggctgtaggtgtcgcggtaggcgatcttgtcgggattggcggtgggtggttcgggcaggatgtgggtgagggcaggccatcctgcgaccgcaatagccgcgacggcgaccacccacacgatctgttgcatgggtctcatcatggcccatcatcgatgagtatgggtggccgacatggggtcactcgtagaggggatcgaggggtgtgcgggcgagcatggcttcctgtgtgccgagcatgagggtgccagagtcgtcgccggccgattcccagtcgacgatgatctgcccgctgtcgaagctggattcggtgatggtcacccattctccgtcgatattgatgagcaccccagcggccagctctgtggcagcaaccgggtgaggtgggttgtagaagcggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttaggggctgattcgccggataggtaggtgccgcggccgcgtttgccgaacgggattcccacgccgacgtgttcggagccgaacatcatgcgggctccgtcagcagacaggggtccggtggcggcacgcccggagaagttgtctcggatttcgccgcccaggaactcggcgtcggggcgttgggtccccagatcgacgtggatacggcagg

SEQ ID NO: 282 - DNA, 1677 bp, Propionibacterium acnes
ccccctcttctgggtggtggtccggggcgtcaccgccccggaccagttgggtagtcatctcagttgaaataagcgattagtgatacgcccctcatgctttccggtgctgtcatgagcgtctgacaacagcgacacctcggggcagccgacggacagtcctctggctgccgctctgatcccatgcccacggcacgaaggtgtcggacagctcggtctcgtcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgccccgcctggtcctccagccacgacaacgcatcccgaaacagcccgacgtcttccaaagctaaaccacagtcgtagccgcccttgtcccccaaccgcacaatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacggtggtggggcaggtttgtgacctcgtgacgcagcaggttgcgcttgtgcatctgccgttcgagacgctcgggctgacctgttgacggggttgagccgtggcgccgcttcctcggcggggtctcgatccgttgctcttccggcggttcggcgtcaggttgtggtgcgcgatctcccctaggacgggggggctcgccacctatatccgagggacgatgagacggccttccacgcttgctgcgcactttcgcagcccgccccttgcggtcacatcgacgcggcggcggagtgacgtcctcaccgcgcgctaactgcgtcaacgccgccaccaggttggtgcccggtttcagccctttcagcacgaaccgcaccaggcgggggtctcggccgattcgtcgggcaatctcggcttggctccacccttcggctaacagggtgcgcaacaagtcttgggcccggttatcacgctcagtcactggtcgcctcctcggggagtcctgcctgctcggcctgctctgatagagcagcccgttccgatccggtctggggcgctttcaggggaccgggtaggacacctttgacacgcagtcgcccgtccttgccgtcgtcgccgcccccctgggccacagggagcgcccgggggggcacgttgctggtgtagatggcgtcgccgtggatagccagcagggtgcgggagttcatgcgtagtgctcctcccttggttgtggcgttttttccggtggtggggtcggcgatgggtgtgttgagggtgcgtacgcgggacagggcccagata

SEQ ID NO: 283 - DNA, 3558 bp, Propionibacterium acnes
aaccgtcatctggcgtggagtagcgagctgatgcaggaaggcaatttgtacggccttcccgaggaagacccgttgtggggcgaggccgtggagctggtagcgggacttatcccctctgtgcgggcgatgtggtcgcacgatgggcagaccgtgactgtgtcggctggccggcgggtggcgacactggggatgccgatgcggggatggcgtggtatcgagatgcgcggctggaatccagtgggcgccgatacgtggtggatcgttgaccaggtgggtagttggctggtcgatcaggatgagccgatggtcgttgacgggagggtgctccatgaggcgtgggaacggtcgcagatggtccgttcaggccgctgagaaaaaatttaggtccgccctgcatatcggggcctcttcataccttcaaaagtgtgaagggaatacagactcttcgactggaattaaaatggtatatggcgtgtccggtccgcacccagctccacgatgcgccataggggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgacgtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaaggttctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagatgcgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagacctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctcccggagggcgtcatgaccgctttaattcaagctctgccgacagctgaactgtctgctggacctggtgctagcagtccagctagaccctctgctgagggcttcatcaagat

SEQ ID NO: 284 - DNA, 3282 bp, Propionibacterium acnes
gagccagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggattggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcggggtgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagacccgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaacgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagaccaagaagacctagaagatccaaaagaaccggtttcggctgttgcttcggtcttcatggtagctgatagcccgcgtcgttggaagtgcgacgacgccgatcctcatcggtatcgcaccctgaaacagggtgttgaacatgaagggttgaccgctatgtcaagccatgagacgccctcccggagggcgtcatgaccgctttaattcaagctctgccgacagctgaactgtctgctggacctggtgctagcagtccagctagaccctctgctgagggcttcatcaagattcatcacgacctcattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggagagacgtcgggagagtgggtgaggcattggctggtgtggcggatgctggccggtcgtactggtgtggctcaggcccctacgaccatcgtggcccggttcctgggctgttcttcgcgccaggtctcccatatccgtggggctctcgttgatgccggtctgctcggctgtgacgaggtgtcgggggcggcgagccgggtgtggttcccctcgatggccgaggagtgtgcagcggatcgtgaggtggtcgatggggccgtcgtcgatgctgaggtgggctctggtgaaggtgtcgaggagggcggggaacccctgtcgattttgtccacccacccctgtc

SEQ ID NO: 285 - DNA, 3093 bp, Propionibacterium acnes
gtcgagaatggccttgaggacgagggcttggattgtggtgtcattctgggctgccttgaccttcagtccaacgccgatgtcccgggggattctggtctgcaacttgaacaggtctgcctccttggttttgaacagtttggttgcagggttggcaacgggctgttcttggcgctggcgtccaaggttgcttttctttcgggcggtcatgacatcatctccaacagttcgtcggcaacatcggcgaagaaggcgatagtttccggctcaggggtacagccgtaggcgcgcttgatgacttgacgcttggggatgacgtgatcgaccaactgcgtctgggagtcgttggctagaaggtcgcgaccttccttgaacagggaggtattcggttcagctttggaaagcagcaccacgcgcggggttcctgcggcggcgtcgtgcgtctcccaggtgcgcgccatgtcgagcccggacgtgtcggtggggatgataaccagatcggcggcgcgaatggcggcggtgatgatgtcaccgttgcccggcggggtgtcaatgatgacaacttcttcgggtccggcgacgaggtgctggagcgtcgccttgttggccggttccacggggaaccccaaggggtcggcgttactcagtgtgcactcggcccaggatgatgctgacccttgagggtcggcatctttgacgcggaccatacggcccgtctcatggagagctgcagccagcaggatcgctgccgtggtcttaccgacgccacccttggcgttgataatgctccagatcatggtgacacctttcagtgaggatgcatatcagtttacctgcaaggagtaaagacggcaagcagttatgccgtttctgcggcaagccgtcttgcatccttggatgtatagatagttgtctacttatggttgtggatcgtggtgtctcgtaccaggatttagtgtgctcgctgatatgcacgactttcgggcggcctgatctggcggtggtgccactaacccaggagtctgatccgcaaggtgtcctcgactttgaggaaggggtctctgctttcgtgttgacctaaagtcaacggccctgggcgatcactgaatcctaatatctttgtatccttccctgattgcatcttagcatccttgaattcaaacagggatggagccatgctgttttgacgacatggatgcactggggtttggttgttgccgatgcggagcgtcaggcggcccgggacgccgccaccgccgacacgctgcgggagatcgtgggactgctgggccggggcggcgaggtcccgcccgccaagacggggcgtaagacgaccggcaggccggccccggcccgcaagtcgtcggccacgcagtaaaggcagggatccgtccctacgcagagagcggaggcagatcctgggggatccgactcttcggttccgtgatcttcccggagatcttcccggatcccccagggctcatcctgatacggggtccgccgacggaccccgtatcagtgggggcgctgccaccagtgatggcgggcgggtcggtcggcgtctaggccccgcccgatggtcgcctggtctacctcgcaggcccgtgctgttgccgaggccgagaacgtctgcccacttgttgccgattcagtcccctctccgtctgccatgtcgccaacctttcctatctggcgtgctcatggacatgcccgggcacgccctcgctgctcagaggcctgctcgttccacctctggccgcgaaccgtatttctgctgaccactcctcgtgcgtgaatatttgccagccttggccattcatatttggactactctgcaccagatatcggactgggaaacctcttgcacatctctaattgtcatctattcgttgggcgcgcgctgttagatcgtgatcataccaatcagaagacaaagcgacgcccttttgagcggcttttcgaacgattctagaccgcgctatatcagcatttctaccgcgcggccagagtgctacactaaattcctctctgcaatccttaagtccattctttacttcctcatccaatttctgcgacagcatttttatggaagcatcgcactctgactcatcatcaaatgcctcaattgcgtgcgttcgccattcacggcgcgtattatcgtagccgtaatgaagtattacccaccgatccacagaatcatcgttaggatctacaactgtcatgaatggcccaactctcgcgctggtgtattctcaattgcagttcagtgactttacttgaccagtcccggatttagtagacgtagacggagagtaccccgccgggaacttgactgacatcactgctgtaccgtactgctttcccgggtggcaaccatcgtaagcagcatttgccgtgacgtacctagtgctctttctctgagtgccggtaatcgccttatatggtacaggtgggtgaatcgtagccgttacggataccgatgacacgtttgcatcacatgaagctgtggcgacataattagttgtcccattgacatgatgagagtcgtggacatactgtcgaggatcgagagtgcaggttattgttgacgccgttgttctggtaccagctgctttcgagctctttgttgcagttacagtctgcggccctgaaggttttactgacgcgactgatgtgttcgcgtgttttgcggcagtgctttgatttggttgtgcttgtgtagcagttgctgatgtcgccagtgatgcccccattaccatagctgtgattatggcgtagtctttacgcttcattgcgcccccaaataagcatgttagtttgctattttgaataggatacgagacatcgccatgacttgtcaagggaagaagtaaaaagaatcgggggggtatcaagaaagatgtgctttcatcaggacgaaagcggatgggtccgttcgacttggtgacgaatgatccggccttgcgtcgcggagaccaggccggcgagtttgtcgagcagggccgccgtggcctcatcgtcgggcacatcactaaagggacgaacaaccatgacggctagggccagaaacgaccggaactgaatcgcatgtggacc

SEQ ID NO: 286 - DNA, 2920 bp, Propionibacterium acnes
acccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgagacctggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggagtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttg

SEQ ID NO: 287 - DNA, 2918 bp, Propionibacterium acnes
acccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgagacctggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggagtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtcct

SEQ ID NO: 288 - DNA, 2920 bp, Propionibacterium acnes
acccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgagacctggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacgagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggagtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttg

SEQ ID NO: 289 - DNA, 3086 bp, Propionibacterium acnes
ggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcaacattgtcgagctgatcgacggtttggcggatggcccgctgatttttctgcatcgcagcgtgacgggtccgggccactccccggatcgccacgtcgaccggcacgccagtgtcgtcgatacggcccaggaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcagcttcggtgattttgttgagggcggcggtccaggcggtgtgggtgcgtattttctggtcttggttgagtttgatcgataggaaccacacgcgccggcctagggatgcggtttcaggctggtcgagggtggcgtcgatttcgtcggcccacacggggtgttcgctcaggtcgaggccggcggccatggcgtcgacgatttctgtggggtcggtccaggtgagggccccgttgaggcagaactcgtggcgggcgaggtggcggaataggtcgcggtgagctgcggcgacggtgagggaggcgttctcggtgacgggtcgctggaggggagtaagtcgccaagtggcccagatgtcgccggtggaggtccagacgaggttgtcgaagaggaaccgttcggggatggacatcatgactccttttcggcggcggcgaggaaggcttccaggccgctgcggcgtacagcgttcccggtagggtgcaggggttttctgggggtgggttcagatttcgaatgtgggaagagtttgtggatggtatcggtgtcctcggcgagggcttggtcgagcaggcaggtggccggggtgtcggtcatctcgtccagctcgtcgatcatctcgtcgaggaggttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgacagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttgccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggcggcaacctcccagcggcctgcacgactgacaagagtcaggccgtactggctagtccgggtagtggattcgtcaccggtgggctggcatgtcacggtcaccgtgacggtaatcttctgccgatctgagggggtggggacctcgtcaggccccaccacatgagtggttttcaccgatacacacggggctgggtcaaccgcggtgaaagcggtccccgggctactccatctcgacaggtcagtattcccggtcagcatggcggccaagaaacccgaagaggtctgggcagccgggtcagcaggacgaatctccgaggagtccacgtcgggggctgaggccggtgcaggcatggggatctgcccaggtagacgcaaggcgatggccttgccgccggcatcgacgtggaccggaaccgaccaggcctgtccgctcccggattggccgcccatggtgaccacggtgacctgccacaggctcggatcagacggggagacggtagcgtcataggcggtgacggtggtgggcg

SEQ ID NO: 290 - DNA, 3075 bp, Propionibacterium acnes
attttgtccacccacccctgtcgattttgtccgccaagtattagacaaaccattagacagtgaattagaccttgggtcgcgtcagcgtgttagctcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcggttcgtggggtggtgtcctcagctggtaggggcaccgaagaaggtgcgtggccagctccgtcagatggttgccaagcagatccgtctccatcgtgcctggctggatgtgccggcgttgactgttgccgctgagcgagtccgggaaatcggggcgctgggtgatcggcactgcgagatcgttcgagacgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccaccaggcccgagacaccctcacccacgacaacccccatgaacgccgcctggcccgcgaacaccaccgcgcccaactcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacacacaccgtgaaacacgacaagccacctgacagtatcagctgcaagacgcatgacaacatagaaggacatgatgaaatacacatagacacaaccccgcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaaaccgacccattcgcccgccagaaagcagcagaagaccgcgcccgccaactccaagacgaagcccaacgccacgcccaccccaaacgcgtcatcggccccaccgcacgattccagttcgtcctgccagccgacgtgctcaccggcctcaaacacctcgccctcacccgcggcaccaccgcccgccaactcaccctcgacgccctcgacaccgcctacggcctcgacaccctcgccaacagcgggaagaaaacccacccatgacccgtgggtccccctgccaccaccccctcgacggcaactgtgtgcgagccacaggcccgcacacaggcggcagcccagtgccgtccccgccaggaaaggaactgaacttttctggagtgctggctccctatcaccccttatggtgctatcagatccagtagcgccagcccgagaggaaacccatgagctacatcgtccgcaccggaaatctagccggcacccccgagctgcgcgaggggtagccgacacggcggaccgtgcccctga

SEQ ID NO: 291 - DNA, 2821 bp, Propionibacterium acnes
ttcaagttccgggaactaccgccggtcacgctgattgattcccgggcgatctcgcttctgacgacagtggtcggtgaccgagaggagtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagccccgcgcgccgcagtcgcgcctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcaggtgttccacacgtaccacgcatcgactggttcgatccggtagcggctgagcctggcgggtgagaaccactcctgcaacgtctcacgactcaccgtgggagcgtggtaagattgatgacgataggcctcgggaaggtcaatgccgcgaaatatcggtatacccccgaggtcattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagccgttgcatgagacgacgcctccgcccgccacaccaacggtcaccgccacggccacggtgaccgtgaccgtg

SEQ ID NO: 292 - DNA, 2653 bp, Propionibacterium acnes
tggtagcagtaggcattcacccgtgacccacggttaccggaagccccgccgcaatcgataccactgtcagtaccatcaggggcgataggggtcaagctctccttgtcacaatcccttccccggcagcccagtaaccgtcgcttacagccatacatggatatgcgcccattcgtcggcaccgacgccgtgcgggttggcgacgctgacccgtctgctcacaaacgacccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgaggccaggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtaaccgagaggcgtcctactctgaccccgctgctgcggtgagtaaatcacgggcgtcccggatccggccacccgtccaagtgccagccagcttgatcggctaggcatcgtcaaggagcgacggtgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccag

SEQ ID NO: 293 - DNA, 1468 bp, Propionibacterium acnes
cgtccagatcatggctggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgtggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccagcaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagccccgacgagacgacgcctccgcccgccacaccaacggtcaccgccacggccacgg

SEQ ID NO: 294 - DNA, 2704 bp, Propionibacterium acnes
gggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacggcagtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtccccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttggttggcaggcctgggtttgatcggcttgctgggacccggtttgggctccggagtcttaggctccggcttcacatgcctaggcacttcggctgcggtgggaggagtcagcacgtggcgtactggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctgctagcagtagcatcgagggctctgtggcccgtcgttgccctcaccggtgcatccttgccctggcgggtctgcttcgcgatcgccgacatgccgcctcgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccgatccggtgagcttgcgaccaccgctgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaacccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatccgagacagcgccacaccgaactgctgggtgcgagccagcggagtagccaatgtcgtcgtatcgcctgcgaacttcgccaccggggccgccaagaaacccaacgccagcgccgcagca

SEQ ID NO: 295 - DNA, 2471 bp, Propionibacterium acnes
aggcagggtcgtcgggttcctcgactaccggaggtggggtagggctgagctgttcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgcctcggccgcgtttaccgaacgggatgcccacgccgacgtgttcggagccgaacatcatgcgggctccgtcagcagacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggccgggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagagatttcagtgttttatcgaggtgaccagccatccggtctgcgctgcgggttcaggtaccagggtcagatgcagcatggtgtggtcggctaggggcacggcgaccaggggcccgtcggcgctcgccccggtgagggtgggagttccggccacggtggtggcaggaatctggttgggtttcgcggccatcagggagcccatgagggtcggtgcggcgatctggacgagggcgactttgcgggcggcgggatcgcgggtcaaccagccgcgggtgaaagcgagcgccgccgacgtgatatcggggctcagcggggctggagtggcggctgggtgggccgttgaggagggccacacgcgcggtagcg

SEQ ID NO: 296 - DNA, 2537 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggttcttgtctgcccagcgtttctcggcgatgtcgatcatgtcttggatggttttgacccatcctcggatgggatcgactttggtcagtttgatccctccaaggaactcgatgggcttagtaacgggcccgtcaggaccgaattcggtgtcccagccttcgtcgatggctagtttcagttcggcggcgtcaacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgtgagcttcggtggcgctgagcagagtggcgggtgcggcaccgatctctccggtcactgatccggcatacatgaatcggccgtcgatgtacacgaagttagggatagggccggcaggcacggtggggcgccaaccttgttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgccgcccccctagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcggtagctgggcatgtcaccctcccctatctgtcaaatgagctagacacagtgtctatttaatttgacgcaaagtcaagtgcattagacgcctttgtgtggatccgccccaccagacaaacactcgcgcctcatgacccgccgcgaagccttaacgaaaccaaaccgcttatagaaccgctccgcagcgctccccgagggctttagctccaaggtaagaccttgctcgtcggcccattggcagacttgtgtgaggatctgtgagccgtagccctgatttcggggggcggcatgcacgcacatcagcatgtgaccatgacggcgggtcggcgggctgacataagccccaccacgccagtccggtgtgatctgccaacttcgccatgccgcagcgcgccagcggcgggcctcggtagccaccatgatcaccgcgacgacgacgagcgttgcggccccgatcatggccagctcactccagccaggccagttcccggagatgatccagcctcccagcgcccagatgatcatggcttccacgcccgccgcaatcgggacgagtggggcagtacggatgcggcctgccatgatttcggtgatctcgctgcgatgccacgaccaagagaactcccacgaggcacgaattaggctcatgcgtgaacggcttcctcggcttcgctttgccatagcttctctagacggcgctcggct

SEQ ID NO: 297 - DNA, 2332 bp, Propionibacterium acnes
ggcggcgcaccaggtgcgccgccttcccccgtgctggtgtctcgtcggcttactggtgggggtcgtaggggaacccgtaggtgtgttccagggccttgcggagaaggtcgttcatagttgtgtgttcggcgacggccttcatcttcagcgccgtgtgggtggcggtgggtagcttgacgttgaacgcggtgatcggggtcttggccgactggaaggtttcagagacactggctccctggctggccgccatttggtcggcgtaacggctggctttgtcggcggcggtgggtttgcggttcttactcacttcagcatctccttgattcggtcggcaacctgggcgaactctcctagatctgttggccgggttccgatggcttgccgataggcgacccgtcgatgaacctccgcatcgagaacgtctaggccctcaacggcggcggccccctcgtgggcatcacggtattgcctggtccaatcggctttgttgaagagcagggcccggcgtgtgccgtgggccacctggtaggtcattagcgctcggtccatgtccaggtcccccgactcggtcgggatgatgaccacatcggcgatgtcgagggctgcggtgatcgtctgagagtcaccggggggagtgtcgatgatgacaaggtcggcgtcgatgtcacggcagcgcctgacgataggggcattagccgggcggacctcgaagcccagcgggtcaccagtctcgaaagcgtcggtagcccatgacgtcgccgatccttgcgggtcggcgtcaagcaagatgactcggtactgagctgctaaggccgttgccaggtagaccgccgtggtcgttttcccgaccccgcccttggtgttgacaatagaaatactacgcataaatacatcattacacatgtgcatcgatgtatctgtatatatgtgtatcggcgtgttgtgagggaaaacccgggccacatacaacgatcccccagccaccacagccgggggatctctcagtaaagccagcaactcccacagaagttgcacccccacgatacccaccacatccgtgtcaagcccccacaacacccaccagcgccctaggcttcccccatgaacattgacatggacacaccaaccgaaaccgaagccgacaccttcgatgccgtcctcgccgacattaaccacatcaaccgcctcaccgccgacgaaatcgagtgctactccatgggagcctgtctcctcctcctcaaccaccaccccttctccgaactccgccaacactgggccgacaaccccaccgacgaaaccacgtggaccctctacggggccatcatcgccgcctccaccctggacccccacctcagcatcgacgccctagcccgcctctaccagctccccctcgacctcgtgacccaagccctcaccgtctaagcgtcgatgagcgggggagaggtagcgcactatcggctaaggaaccccacaaacaccaaacccttgtcactgggaagggtttggtgttatgctggtctcacaactcaacagaggaggtgagacatgggaaatgagtaccagaagtcgctcaaagtcctgttcaagaaactggaatctgagcaaggagcccgcatcgagacccggcgcaaaggatggatgatctacccgccggatacgtcacgatcagcggtcatgatccacaagactccatcagatcgcagagcatgggccaacatgctttccgaactgagacgctcaggattcaccgtctaactcagtgaagggggctggagctccagccccctttcaaccacctcccccggacaccacacaagaaaaggagaacatgatgtggcacgttcggttgtcgcttcgcgcaatcagcgaggacatgctgttcgacgccctggacaccctcgaccccttatccccggtggccacactgggccccgatgagcacaccggatcattggcggtgttcgtcgaggctgactcactgacagacgccatcgagactgcccgcacagccatcaccaacgcatgcaacaccgccaccataaccggcgtagaagcccgccccgaagacgaatgcttcgcagacgttgaccggcccctgttcccgccagtggtcggatacaccgaaatcgctgaaaccgcaggactctcacgtcagcgcatccgccagctcgcaggcaccgccgggttccccgcacctgtcatcaagaccgcggccggcccgctgtttcccaaagccgccgccgagcagtgggcgcggacacgccagcctaaggcaggccgcccaaaactccagaccaccacctcataacacatcccgtgtgctgaacctgtt

SEQ ID NO: 298 - DNA, 522 bp, Propionibacterium acnes
cgacgccgcggcggggtaacctcctcgccccgctccaactgtgttaacgcctcgaccaggttggtgcccggtttcagcccttttagcacgaaccgcaccaggcgggggtctcggccgattcgtcgggcaatctcggcttggctccacccttcggctaacagggtgcgcaacaagtcttgggcccggttatcacgctcagtcactggtcgcctcctcggggagtcctgcctgctcggcctgctctgatagagcagcccgttccgatccggtctggggcgcttccaaagggcccggcaagacacctttgacacgcagccgcccgtccttgccgtcatcgccgcccccctgggccacagggagcgcccaggggggcacgttgctggtgtagatggcgtcgccgtggatggccagcagggtgcgggagttcatgcgtagtgctcctcccttggttgtggcgttttttccggtggtggggtcggcgatgggtgtgttgagggtgcgtacgcgggacagggcccagat

SEQ ID NO: 299 - DNA, 522 bp, Propionibacterium acnes; identical to SEQ ID NO: 298

SEQ ID NO: 300 - DNA, 2317 bp, Propionibacterium acnes
aggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactcatcatcgacgggcgcatcttgtacgaggcatgggacaggctgcaaacagcccgtccggcccgctagaaaaaatttttagggcccgctccgcacatcccggtctgtacccacaccttcaagggtgtgaagggaataaaaacacacctaacaacaactttgtttcatgatttggcgcgtcggaccctttctgaccgatgtcgtgcgcaacaatggacccatgagttcgcctaccaagatgcgccggaaggggacacgcggcccgaaacctcgcagcgacgaggagctaacggctgtgatgttccgcgtcccagagtcagtggccgaacgtgtcagcgatatggcttgggagctgaggctctcccgatccgatcttgtgggctggtcggccctctatgcactcaactcgatgctcagacagcgcggagaggacacgattccggttccggagtatctggacaaggccgtgctcgctgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagacctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctcccggagggcgtcatgaccgctttaattcaagctctgccgacagctgaactgtctgctggacctggtgctagcagtccagctagaccctctgctgagggcttcatcaagattcaccacgacctcattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggcccggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcgatgctgaggtgggctctggtgaaggtgtcgaggagggcggggaacccctgtcgattttgtccacccacccctg

SEQ ID NO: 301 - DNA, 2290 bp, Propionibacterium acnes
cccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggcttggaccagctgacccggacgagtggggcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcgacatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccatgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcggagaacgtggattggccggttgtcgcggagctagccagtacggccactgatgaggttgaggctgagatcagccggtggagttccactcatgatggggtggcgacgctagacattcgccaggccatcgcggagcctgctattgcctcggcggtgtctacgtatgctgaccgacgccagatcgatgtaggggagacctggcctgatctggtacgccagcgataccgcaaggctgtgtgggatcag

SEQ ID NO: 302 - DNA, 2310 bp, Propionibacterium acnes
ctgtgggagacgatcatcacgtacccgttagatcgtcgccctgacaagatcgctgcgaacctcatcctcgacacgttgcaccgggttacccggttttggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaattgatctagctaccatatagctgatgatctagctatcatatagctgtgtctccagcccaaaggacagcccaatggcatgcttgccacaggaaggtgcgtcagcctcccgaaatactggaaggagctttaccgtgcaggacatgacctcgaccagaccgattgaccgatccccgttcgaccgcactattgcggtgtggaaccacaaaggcggcacgttcaagacgtccgtcgtggcgaacctgggatacctgttcgccgccggtggcaacaaggtgttgatggtcgacatggacccccaggccaatctcgacattgacttcggtatacccgcgggagaacgtgaacggggcatgggattagccgaggcgctacgtgaggggacggcccttcccccaccgcagcatctcagcgaaaaccttcacctggtcagtggcggcccggccctccacgagttcaccgaccccgcatccttagcggccatcctcgaccgagtcaccaccgcacgctacgacctgctagctcaggcccttgccccgctggcctgggactatgacctcatcttcatcgactccgggccggcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgactaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcgacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaaggatggtttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgct

SEQ ID NO: 303 - DNA, 2632 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggtttttgtctgcccagcgtttctcggcgatgtcgatcatgtcttggatggttttgacccatcctcggatgggatcgactttggtcagtttgatcccttcgaggaactcgatgggctgggtgatgggcccatctggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggagtggttcgatagctgggcatgtcaccctccccccatatgtcaatctaactagacatattttctagcccatctgacacattgtcaaggacaatagacctttcgtgtgaatccaccccgtcaaatgcacactcacgcctcatggcccgccgtgacgccttaacgaaaccaaaccgcttatagaaccgctccgcagcgggcccggagggcttcagttcgagggtgagaccgtgctcgtcggcccattggcagacttgtgtgaggatctgtgagccgtggccttgagtgtgggggacggcgtggacgcacatgagcatggggccgtggcggcgcgctggcggggccacgtaggctccgccatgccagtccggtgtggtctgccaacttcgccatgccgcagcgcgccaacggcgggcctcggtagccaccatgatcaccatgatgatggacagggttacgacgccgactatggccagctcaccctgaccaggccagttcccgcagatgatccagcctcccagcgcccagatgatcatggcttccacgcccgccgcaatcgggacgagtggggcagtacggatgcggcctgccatgatctcggtgatctcgctgcgatgccatgacaaggagaattcccacgactcttgaatcatgctgatgtgtgaacggcttcctcggcctcgctttgccatagcttctctagacggcgctcggctagctcgtcggggcacggcgacagcctgccgcactcggagcagaccccgaagtggcgcgagagagtgatgaccggctcgtcgggagcatgaaccga

SEQ ID NO: 304 - DNA, 2061 bp, Propionibacterium acnes; identical to SEQ ID NO: 205

SEQ ID NO: 305 - DNA, 2219 bp, Propionibacterium acnes
gctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactca

SEQ ID NO: 306 - DNA, 2218 bp, Propionibacterium acnes
caccaaccatgcatgaacgcaagatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctggggatagaacagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgaggccaggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtggggatgacgggttcctgccaatcgatggttgacaagtcgtcggcggcttgttggtaggtagggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtg

SEQ ID NO: 307 - DNA, 578 bp, Propionibacterium acnes
ggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttg

SEQ ID NO: 308 - DNA, 2201 bp, Propionibacterium acnes
tccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcatactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactca

SEQ ID NO: 309 - DNA, 2334 bp, Propionibacterium acnes
cccgcggcgtccgctggggcgagtgcgtgtctgtcatctcatcttttatcgtcatgtttccccttgtcagaggggtctttgcaaagtgacaacgtcaggggtcttgacgacaacatcctcgacaacatcgtggcggtggtctgtgtcttgtcagttcaacgcaccggggaaagaggcaccgctgatgttcaccaccacaaacaccctcaacgatgaatgggaccagattcgcgccatcgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcgggtctgtgggagacgatcatcacttacccgttggatcgtcgccctgacaagatcgctgcgaacctcatcctcgacacgttgcaccgggttacccggttttggcgtgctgattcccccgatgaggaagaggctcacggtctgctgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcggtctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaatttatctagctatgtatatagctgatgatctagctatcatatagctgtgtctccagcccaaatgacagcccaatggcatgcttgccacaggaaggtgcgtcagcctcccgaaatactggaaggagctttagcgtgcaggacatgaccagtcctattgaccgatccccgttcgaccgcactattgcggtgtggaaccacaaaggcggcacgttcaagacgtccgtcgtggcgaacctgggatacctgttcgccgccggtggcaacaaggtgctgctggtcgacatggacccccaagccaatctcgacatcgacttcggtatacccgcaggagaacgtgaacggggcatgggattagccgaggcgctgcgcgaggggacggcccttcccccaccacagcatctcagcgaaaacctccacctggtcagtggcggcccggccctccacgagttcaccgaccccgcatccttagcggccatcatcgaccgagtcaccaccgcacgctacgacctgctagctcaggcccttgccccgctggcctgggactatgacctcatcttcatcgactccgggcctgcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcaacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggggacggtctcggatctgg

SEQ ID NO: 310 - DNA, 2280 bp, Propionibacterium acnes
gacgccggccaccccaactactccgacccacacggtgaccccagctccggcctctgccggccactcgaccagcgacgagcacccaatccatacggataccgccgcagcggacaaggccagcgacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgtgactggtccgacgaggtcaacgtcaccctggtcggccaggtgtgcccgggcctagaagacgcactagagtctccgaccctgacccgcgccaccgacgtggacgccctcctcaccaccctggaagctcgcgccgacgaccagcgacacatcctcaccgaaggaagccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccaggttcgcgtcgacaccgaccaacccggcaccgacacccccttccccatcgacgacatcgacccgctgagctccgaccacccggtcctatccatcatcggccaccccgacatcacaggtgccactggaaccgttgggcgctccccgtggcgctgccaacagttggccctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggagacttggggctggcccggtgggcgctgacccaagggctactggtgtctcccgatcatgaggacctggtcgccggttgtctgcgcaccgaataccaggccggcaacatggacaaggtcgccgagctagttgatcacctgtcggctaccgcacgccgactgggcgtcgacctcaacgaggacaccacccggatcatcgatacggtcacccacgccgacaggagagcatcatgatctcccctgcactcatctccgtcaggaaggtccctatgcaccattatcgtcttggtatcggcactgccctcatcgccgtagcagcc

SEQ ID NO: 311 - DNA, 594 bp, Propionibacterium acnes
gctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgattggagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggtttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcc

SEQ ID NO: 312 - DNA, 2594 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggtttttgtctgcccagcgtttctcggcgatgtcgatcatgtcttggatggttttgacccatcctcggatgggatcgactttggtcagtttgatcccttcgaggaactcgatgggctgggtgatgggcccatctggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcgggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcggtagctgggcatgtcaccctcccctatctgtcaaatgagctagacacagtgtctatttaatttgacgcaaagtcaagtgtgctagacgcctttgtgtggatccgcccgcccagacaggcactcacgtctcatgacccgccgcgacgtcttaacgaaaccaaaccgcttatagaaccgctccgcagcgggcccggagggcttcagttcgagggtgagaccgtgctcgtcggcccattggcagacttgtgtgaggatctgtgagccgtggccttgagtgtgggggacggcgtggacgcacatgagcatggggccgtggcggcgcgctggcggggccacgtaggctccgccatgccagtccggtgtggtctgccagcttcgccatgtcgcggtacgccagtggtgggcttcgagggccaccatgatcaccgcgacgacgacgagcgttgcggccccgatcatggccagctcaccctgaccaggccagttcccgcagatgatccagtctcttaacgcccagatgatcgcggcttccacgcctgctgcgatcgggatgagcaaggcagaacgaaggtgtcctgccatgatctcggtgatctcgctgcgatgccatgacaaggagaattcccacgactcttgaatcatgctgatgtgtgaacggcttcttcggcttcgccctgccatagtttctccaaacgacgctcagccagctcgtcgggacacggcgacagcctgccgcactcggagcagaccccgaagtggcgcg

SEQ ID NO: 313 - DNA, 2383 bp, Propionibacterium acnes
tggttgtcgaccacaacgatggttcccggtcaacgctgccgccggtggccgactcggatgccgagctggaatcccagatcgcccggatggcgaggaatgcgaccccgcggcgagccttcgacgccgatcacaccgatgtgacgatcatgcaccaacagaagttccgtatccacgcgatctcagcggaagtgtcattgcaaccgtcggtggtcatccgccaacatttgctcacccaaatcagtctgggggacctgtcacatcgcggaatgatgccggtggaagtggcccggttcctcgatgaggcggtacaagctggcaagtccatcgtggtcgccggcgagcagggtgcaggcaagacgacgtttttacgagcgttgatccacgccattccgatgcgggagcggttcgccacgttggagaccgatcaggagttgttcgctcatctgatgcctggccgggaaaacacgctggtgctgttcgcccgtgatggtaacggcgaggtggatccggcgactggcacccagcacggcgctatcgagatcgcccagctgattcctcctagcctgcgccaggcgttaactagggtcattgtcggtgaggtgcgcggcaatgaggcctcggccatgttccaggccatgcagtcgggtacaggcaccatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcccggatcggccgccgacgagctgtctcacttcgcccgagacctggattactgcgaggcccactcatgaacactcccgcactaaccagcgccctcatcgtgaccgggttggggctgatcctggccatcgacgggctggtcccggcgccgcctcgacctggggccccgctgagcccggaccaaaggtgggccaggctcacccaccgtcccacaggagcggccgggcgccgccgggacctgcgctgggggctggctgttctcgtcggcgtcgtgctgtttgtgctcaccgggtgggtcgctgcgctggcgttgggccccatcatcgtgctgctggcccccaccctgctgggggcggccccaccaaccgacatcccgctgatggaggcgctggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcacccgcggggagcctcgacaacgttgaaggctattgctggcaacatccaacagcggttgaaagtgctgcggcaggtggaggctgagcggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctggccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaa

SEQ ID NO: 314 - DNA, 2238 bp, Propionibacterium acnes
gacgccggccaccccaactactccgacccacacggtgaccccagctccggcctctgccggccactcgaccagcgacgagcacccaatccatacggataccgccacagcggacaaggccagcgacgaggacgccctgtccccaatccaggtgggcttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgtgactggtccgacgaggtcaacgtcaccctggtcggccaggtgtgcccgggcctagaagacgcactagagtctccgaccctgacccgcgccaccgacgtggacgccctcctcaccaccctggaagctcgcgccgacgaccagcgacacatcctcaccgaaggaagccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacgtggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccaggccaccaaccaggttcgtgtcgacaccgaccaacccggcaccgacacccccttccccatcgacgacatcgacccgctgagctccgaccatccggtcctatccatcatcggccaccccgacatcacaggtgccactggaaccgttgggcgctccccgtggcgctgccaacagttggccctctacatcgctgagcatccgggggtatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgttgatgcggctcttcaggtgacggatcgggctctggaagccggggacttggggctggcccggtgggcgttgacccaagggctactggtgtctcccgatcatgaggacctggtcgccggttgtctgcgcaccgagtaccaggccggcaacatggacaaggtttccgagctggtcgatcacctgtcggctaccgcacgacgcctgggcgtcgatttgagcgccgacaccacccggatcatcgatacggtcacccacgccgacaggagagcgtcatgatctcccctgcactcatctccgtcaggaaggttcctatgcaccat

SEQ ID NO: 315 - DNA, 2099 bp, Propionibacterium acnes
gacgccggccaccccaactactccgacccacacggtgaccccagctccggcctctgccggccactcgaccagcgacgagcacccactccatacggataccgccgcagcggacaaggccagcaacgaggacgccctgtccccaatccaggtgggtttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccagaccaccaaccaggttcgcgtcgacaccgaccaacccggcaccgacacccccttccccatcgacgacatcgacccgctgagctccgaccacccggtcctatccatcatcggccaccccgacatcacaggtgccgctggaaccgttgggcgctccccgtggcgctgccaacagttggccctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggagacctggggctggcccggtgggcgctgacccaagggctactggtgtctcccgatcatgaggacctggtcgccggttgtctgcgcaccgaataccaggccggcaacatggacaaggttgccgagc

SEQ ID NO: 316 - DNA, 2126 bp, Propionibacterium acnes
tgggctgtagaggaggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggattcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggcccgccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcaccaacagtcggggcagacgctggccgcttcgagaccgaggagggacgagacaagggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgc

SEQ ID NO: 317 - DNA, 1956 bp, Propionibacterium acnes
ccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgagaactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccattgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactca

SEQ ID NO: 318 - DNA, 2383 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggtttttgtctgcccagcgtttctcggcgatgtcgatcatgtcttggatggttttgacccatcctcggatgggatcgactttggtcagtttgatcccttcgaggaactcgatgggctgggtgatgggcccatctggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcgggcgcgttcgatgacgcacgtggtgacctcgtcggtaaccgtgatgaccagacgataatctttcccgtctggggtggttcggtagctgggcatgtcaccctcccctatctgtcaaatgagctagacacagtgtctatttaatttgacgcaaagtcaagtgtgctagacgcctttgtgtggatccgcccgcccagacaggcactcacgtctcatgacccgccgcgacgtcttaacgaaaccaaaccgcttatagaaccgctccgcagcgggcccggagggcttcagttcgagggtgagaccgtgctggtcggcccattggcagacttgtgtgaggatctgtgagccgtggccttgagtgtgggggacggcgtggacgcacatgagcatggggccgtggcggcgcgctggcggggccacgtaggctccgccatgccagtccggtgtggtctgccagcttcgccatgtcgcggtacgccagtggtgggcttcgagggccaccatgatcaccgcgacgacgacgagcgttgcggccccgatcatggccagctcaccctgaccaggccagttcccgcagatgatccagtctcttaacgcccagatgatcgcggcttccacgcctgctgcgatcggga

SEQ ID NO: 319 - DNA, 718 bp, Propionibacterium acnes
ccggggccctgctgctggtgtgggacgtcaccgttttgaccgggcccactctcggccaccgcgtgcgtcctctcagtaaggacgccgagctgactgcccggcgctggctcgaccaggtcgccgacaaccccggcttcctcgacacccttatcgaggccgcccgcatcaccgatggatggcatcacgcgacgcctccgcacattcaggccccttaccggacccttcatcagtgaacggaggtacaacgacatgaccagcgacattgacattgaccggacccacaaacccgacgaccgcgccgaggctcctctttaccggtcctgggccaggagactcgtgcacgtctccgggatgccctggcgtatcgtcgccgccttggccggggtctcccccacctccatgcaccggcttctattcggccgcaacggtcgacccgtggaatggatcggcatcaatgatgctcgcgccctgatggatatcggcatcgatgatctcgcctcagcgtccaccgaccgtatcccggcccgcgaatcccgcgagctgttggtagccctgcacaccctcggctggaccgatgagcatctaagccgctggctgaccagtcccgacctcgacctggccaccacccccaaggccctctacgtcacccggctatccgccgcccgcatccaggccacctacgacatgctcatcagccagcccgtccgccgctgcggcc

SEQ ID NO: 320 - DNA, 2014 bp, Propionibacterium acnes
ccggagtatctggacaaggccgtgctcactgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagatctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctccctgagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggctcggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcgatgctgaggtgggctctggtgaaggtgtcgaggagggcggggaacccctgtcgattttgtccacccacccctgtcgattttgtccacccacccctgtcgattttgtccgccaagtattagacaaaccattagacagtgaattagaccctgggtcgcgtcagcgtgttagctcaccaacgcgcgcgcgtgcggcggccgagccgccgaagccaaagaaacccacaccaccaacgcctgaaccagcagcccccgcttcagacagtcctgtgtcagcgcacgctgatgaggctgccgagttggcgtggcagttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggacgtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcaccgcgatgtgccaaatcgtgcgcaccgccctggaggccgacctggccgccggaacccggtgggaggaccgatgaggg

SEQ ID NO: 321 - DNA, 1950 bp, Propionibacterium acnes
tcggtgtccccggccatgcgggccgcactgcgactccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctggtattcatcgatttggtcgtgctggaacggctcgccaacgaaacctccgtcgacgcgctcaccaatgcggcaaacatgtcggactcgccgctattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttacgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacaccgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgcgttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaagctcagcgtgtcgtccatccggtcccggggtcggcacaggaggcagcctcgcagatcactagtcatggcggggtgcgtgatacccggatatcggtcagtgatgacggggccactgtcacggtgaccgtggtgggccgggccccatcgatgctggggctgcatcttcctgctgtgtcgtcgacagcgtcgatgcccaaggagcgcctgtcgtgaggcgaagtgagcgcggcggagcaagtctaagcgtcgaggtgctcatgtgggcgccgatcgcgctggtgatcatcgggtttgttgtgggtatcggccggatgtcgatggcccaggacgcggtgagtggcgcggcgggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttggattcgggtcccggacggtgcacgcaacggggtctgccccggtagacacctatcgggaaaggagaggctgagatggcccgcgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcg

SEQ ID NO: 322 - DNA, 2060 bp, Propionibacterium acnes
gcgagccacgaccatcgccaagctgaatggagagcgagcatgagcaccacccctgccgggttcgacttcgacgctctggccgagtgggccgagagcgatgaggcgacccacaccccgcaaaccagccccgtgttccggggcaaggacgccgcgcgcgccagccgcgcattcctcggccgaggacggcccaccctcggcgcggaccacgccaccggcgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccctcttctgggtggtggtccggggcgtcaccgccccggaccagttggggagtcatctcagttgaaataagcgattagtgatacgcccctcctgctttccggtgctgtcatgagcgtctgacaacagcgacacctcggggcagccgacggacagtcctctggctgccgctctgatcccatgcccacggcacgaaggtgtcggacagctcggtctcatcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgccccgcctggtcctccagccacgacaacgcatcccgaaacagcccgacgtcttccaaagctaaaccacagtcgtagccgcccttgtcccccaaccgcaccatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacgatgatgggggaggttggtgacctcatggcgcagcaggttgcgcttgtgcatcttccgctcaaggcgctcgggctgacctgttgacggggttgagccgtggcgccgcttcctcggcggggtctcgatccgttgctcttccggcggttcggcgtcaggttgtggtgcgcgatctcccctaggacgggggggatcgccacctatatccgagggacgatgagacggccttccacgcttgctgcgcactttcgcagcccgccccttgcggtcacgtcgacgcggcggcggagtgacgtcctcaccgcgcgctaactgcgtcaacgccgccaccaggttggtgcccggtttcagccctttcagcacgaaccgcaccaggcgggggtctcggccgattcgtcgggcaatctcggcttggctccacccctcggccaacagggtgcgcaacaagtcttgggcccggttatcacgctcagtcactggtcgccccctcggggagtcctacttgctcggcctgctctgatagagcagcccgctccgatccggtctgaggcgcttccaaagggcccggcaagacacctttgacacgcagccgcccgtccttgccgtcatcgccgcccccctgggccacagggagcgcccaggggggcacgttgctggtgtagatggcgtcgccgtggatagccagcacggtgcgggagttcatgcgtagtgctcctcccttggttgtggcgttttttccggtggtggggtcggcgatgggtgtgttgagggtgcgcacgcgggacaaggcccagat

SEQ ID NO: 323 - DNA, 1856 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggtttttgtctgcccagcgtttctcggcgatgtcgatcatgtcttggatggttttgacccatcctcggatgggatcgactttggtcagtttgatcccttcgaggaactcgatgggctgggtgatgggcccatctggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggagtggttcgatagctgggcatgtcaccctcccc

SEQ ID NO: 324 - DNA, 1832 bp, Propionibacterium acnes
ttggtattggtaggcgatggtgtcaccggttttgttgcggatgacgtcgaagccttcgatgtcggaggggatgtcgtcggcgtcgtagacgacggtggtggtgacggggttggaggccgacatttggccgatggtcacgcgcagcatgtttttcaacgcggaggtgaggattgtcgtggcggtggggtttttgtctgcccagcgtttctcggcgatgtcgatcatgtcttggatggttttgacccatcctcggatgggatcgactttggtcagtttgatcccttcgaggaactcgatgggctgggtgatgggcccatctggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctggggtggttcg

SEQ ID NO: 325 - DNA, 1890 bp, Propionibacterium acnes
ccacccctgccgggttcgacttcgacgctctggccgagtgggccgagagcgatgaggcgacccacaccccgcaaaccagccccgtgttccggggcaaggacgccgcgcgcgccagccgcgcattcctcggccgaggacggcccaccctcggcgcggaccacgccaccggcgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcctgctttccggtgctgtcatgagcgtctgacaacagcgacacctcggggcagccgacggacagtcctctggctgccgctctgatcccatgcccacggcacgaaggtgtcggacagctcggtctcatcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgccccgcctggtcctccagccacgacaacgcatcccgaaacagcccgacgtcttccaaagctaaaccacagtcgtagccgcccttgtcccccaaccgcaccatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacgatgatgggggaggttggtgacctcatggcgcagcaggttgcgcttgtgcatcttccgctcaaggcgctcgggctgacctgttgacggggttgagccgtggcgccgcttcctcggcggggtctcgatccgttgctcttccggcggttcggcgtcaggttgtggtgcgcgatctcccctaggacgggggggatcgccacctatatccgagggacgatgagacggccttccacgcttgctgcgcactttcgcagcccgccccttgcggtcacgtcgacgcggcggcggagtgacgtcctcaccgcgcgctaactgcgtcaacgccgccaccaggttggtgcccggtttcagccctttcagcacgaaccgcaccaggcgggggtctcggccgattcgtcgggcaatctcggcttggctccacccctcggccaacagggtgcgcaacaagtcttgggcccggttatcacgctcagtcactggtcgccccctcggggagtcctacttgctcggcctgctctgatagagcagcccgctccgatccggtctgaggcgcttccaaagggcccggcaagacacctttgacacgcagccgcccgtccttgccgtcatcgccgcccccctgggccacagggagcgcccaggggggcacgttgctggtgtagatggcgtcgc

SEQ ID NO: 326 - DNA, 1795 bp, Propionibacterium acnes
gacgccggccaccccaactactccgacccacacggtgaccccagctccggcctctgccggccactcgaccagcgacgagcacccaatccatacggataccgccacagcggacaaggccagcgacgaggacgccctgtccccaatccaggtgggcttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacgacgcccacatcctcatcgacttggaagccgcaggaaccttgcacctgatcgccgatgacgaccaggtcgacgcggccctcgccgcgatcgccgtggaactggccacctgtgactggtccgacgaggtcaacgtcaccctggtcggccaggtgtgcccgggcctagaagacgcactagagtctccgaccctgacccgcgccaccgacgtggacgccctcctcacccccctggaagctcgcgccgacgaccagcgacacatcctcaccgaaggaagccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacgtggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccaggccaccaaccaggttcgtgtcgacaccgaccaacccggcaccgacacccccttccccatcgacgacatcgacccgctgagctccgaccatccggtcctatccatcatcggccaccccgacatcacaggtgccactggaaccgttgggcgctccccgtggcgctgccaacagttggccctctacatcgctgagcatccgggggtatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaac

SEQ ID NO: 327 - DNA, 850 bp, Propionibacterium acnes
gacagtgatacgtcgtatcggtgccctggtggcactgctggtggtgatagccggcttacccgccgggctcgtggccgcaggcgccccgctagtaccctcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtctcctcattgccgcgttcgcggccgcaccggcagccacaagcacggctcacgccgccgaggccacccatgtggcggtcgccgcccaggctggaccggcacacgcggccggcacccaggacagccccgccaccacctctcaggccccggacgcctccaccactccgaaaatctggaagacctacacggtgcgggccaacgactacctgtggaagatcgccgagcactactacggtgacggcgcccaattccgtcgtatcgccgaagcctccggtatcgacccgcactcagagctgaaagccggccagaaactgatcctgccggttcctaagaacacggccgcagtccactcggttaaagcgggggagtatctgtggaagatcgccgagcactactacggtgacggcgcccagtaccataaaatcgctgaagcttccggtatcgatgcccattccgatctagccgtgggccaaaaactcgtcatccccgggcccctccgccacgacgccacgccgccacaccactcggcgtcgacccacgcgaag

SEQ ID NO: 328 - DNA, 1845 bp, Propionibacterium acnes
attcttgtttggcggtcatgatagcgatgaccgctgcctgggtaggcagtttgtcacgctggaccacagtgacgatggtggtcacgagctgcttctgtctggcggtgaggcctccggcgccgaccccgccgccggtgacagttcccatgcaggcatccccgccagcgcctccaccagagttatcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtggcccgtcgttgccctcaccggtgcatccttgccctggcgggtctgcttagcgatcgccgacataccgccccgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgttgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactggtaatcatatgagacagcgccacaccgaactgctgggtgcgagccagcggagtagccaacgtcgtcgtatc

SEQ ID NO: 329 - DNA, 1875 bp, Propionibacterium acnes
ttgatgagcaccccagcggccagctctgtggcagcaaccgggtgggctgggctgtagaggaggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggattcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcaccaacagtcggggcagacgctggccgcttcgagaccgaggagggacgagacaagggagtgctggtcatgccgcggcctccttgtggcaggtcattt

SEQ ID NO: 330 - DNA, 1794 bp, Propionibacterium acnes
agaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagctcagacgaatggtccctcaccctgacaggtgacccactagccgccgacctggctcccctcggctggcacatccacccccaaaccctctcccccgacctgtacaaccgcatggttgaactactcgccaactccgccgccgcagactacgaacccgccagctggtggaaccacgacgccgacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccagaccaccaaccaggttcgcgtcgacaccaaccaacccggcaccgacacccccttccccatcgacgacatcgacccgctgagctccgaccatccggtcctatccatcatcggccaccccgacatcacaggtgccactggaaccgttgggcgctccccgtggcgctgccaacagttggctctctacatcgctgagcatccgggagcatcgggggcgactatcgccgatgatttggggctatcagcgtcgacggtgcgctcgattgctacacacctgcgacactggttgggagccgacgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggggacctggggctggcccggtgggcgttgacccaagggctactggtgtctcccgatcatgaggacctggtcaccggttgtctgcgcaccgagtaccaggccggcaacatggacaaggtttccgagctggtcgatcacctgtcggctaccgcacgacgcctgggcgtcgatttgagcgccgacaccacccggatcatcgactccgttattacccatacacgcaggagagcatcatgatctcccgttgcactcatctccgtcaggaaggttcctatgcaccattatcgtcttggtatcggcactgccctcatcgcggtagcagccgtggccggctgtcgctcaacagactcgacacccacaccacctccatcccgtgtctccgccacgacatcagcgagctctaccctcagcccgaccccgtcagccggagcggtcagtgccgccgacgccgaaaaggtctaccgcaccttgcacaccaacgtgttcgcattggagaagaagggtggcctggtacccggggaacccgcacccgcatccctctcggactacgccagcggccaagcactcaagaactacatgaccttcaaccaccaaatctcggg

SEQ ID NO: 331 - DNA, 1064 bp, Propionibacterium acnes
caccaacacatccaaaaccatcctcacgctcacccgcacagccaccatctcccacctgctagccatcctcgatggcctaccccaagctgaggggactcactggctcaacactcaacccgacctccaccacatcaccctcgacgactccaccaccggctgggccaccaaccgcaccgacgacaccgacaccggcgtctgctacgacaccagcacccacaactggcagatctgctgacagcatgacgggcctgcccttgaggggttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactcccccgccctgagcagtacactgtactacacagtcattgaggatagaggtgacgtcatgagtttttcgatccgtttacccgaccatgagcgccgcttagcggactcctacgcccgcctacactcacaatccctgagcgaggctttcaagcaagccctcttcgaccgcatcgccgacgagttcgaccttcagatagcacacgaagctctcaccgactacgccaacgacaactaccagtctcgtcccatcagcgagctatgggacgagtgtgacctatgagctggcagatcgaaaccactagccggttcgataaagaattcaaaaagctggaccgctacacccaaaaactcattcacggctggatcacgaaaaacatcgacaacaccgacgatccccgccgccacggcaagcccctcaccggtgatctttctggactgtggcgctaccggatcggtgattatcgcctcatatgcacactcaacgatgaccgcctcatcatccttgccctgtccatcggtcaccgccgcgacatctaccgctaagcc

SEQ ID NO: 332 - DNA, 1639 bp, Propionibacterium acnes
gagccagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatgggtgctgttgctgatgcggccctcgctgctggcggcgctgtgatcggagtgatgccgcagcacttggtggacggggagatcgcccatcctagtctgactcacctcgaggtagtgcggactatgcatgagcgcaagcagcggatgagtgacctagctgacgcgttcgtcgcgctacccggcggcggcggaacccttgacgagctattcgaagcatggacatggcagcagctcggtgtacacagcaaacccgtggccttgtacgactcgaccttctgggcaccgctgaccgcgctactcaaccacatgaccatcgaaggcttcatccgccctgaggaccgcgcctcgctcgtgatcgccgataccatacatcagctgatggccgatcttgagggatggaccccaccaccaccgaagtggcgctcgtgacatagaacaaatgattctgactatggctcattgacatctgcgcagcggctactagctccatcgacttcaaatcgggccttggccgaggctcggttcaggtggcccggaatggatccccacaaattgaatgctcatgatcgaggtgatgaacgcccactctattgtcctacgcccggttgtatccagcgagcaattgaaggtgctgcgcctgttggtcgaccaggccgagccactca

SEQ ID NO: 333 - DNA, 1200 bp, Propionibacterium acnes
ccggagtatctggacaaggccgtgctcactgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagatctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctccctgagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctatgtccatcgtggctcggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcgatgctggggtgggctctggtgaaggtgtcgaggagggcggggaacccctgtcgattttgtccacccacccctg

SEQ ID NO: 334 - DNA, 1639 bp, Propionibacterium acnes; identical to SEQ ID NO: 332

SEQ ID NO: 335 - DNA, 1202 bp, Propionibacterium acnes
ccggagtatctggacaaggccgtgctcactgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagatctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctccctgagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctatgtccatcgtggctcggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcgatgctggggtgggctctggtgaaggtgtcgaggagggcggggaacccctgtcgattttgtccacccacccctgtc

SEQ ID NO: 336 - DNA, 1641 bp, Propionibacterium acnes
tattcgtccagatccgtcaagtcctcaaccgtgcctccctggaaaacgtcgacccgtggaacgggctagaccggctagccgaggacatcaaactgcccgaactcaccgatgtggtctccatcgcccgcctccaaaacgaaggcgcctccctcgtcgacagtttccgggcccgagtcgccgagttacgcgacgcctacctgctgcgcctgcaacaagaatccaccgccatcacccagcggcttggtttgtggacgatcctgcaagccggctcggtcatgctcatcttgctgggggcggccgccctcacactcatcacagccggataaaccgacaccgtgtcgagcccccatatgggccgcgaacctttcataatgatgcctgtaagcaccacaatattgatcacaacctaacaatgaaggagaaatcatgatgaccgatctcgacctggctaaaaaacagatcacctggctggcggcgcacctgagttcccggatcgttgacgagcgtggcggtggtagctctaccgtggagacactgatttggattggtgtcatcgtggcgctggtgattggtgtgggcgtcggggtgacggcctatatcaggtcgaagatgcctcactgacgacgatgcgtagcaggttcacaactgatcagcgtggcggtggtagcgcgtcggtggggatgctcctgctgatgcctgcgatcatgctgctggcattcggtgggatcgaggtcgggatgtggtgtcacgcccatcagtcgaccatcgcggcagcccaaagcgccgcggaagctcagcgtgtcgtccatccggtcccggggtcggcacaggaggcagcctcgcagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggcggagcaagtctaagcgtcgaggtgctcatgtgggcgccgatcgcgctggtgatcatcgggtttgttgtgggtatcggccggatgtcgatggcccaggacgcggtgagtggcgcggctggtgctgcggcccgtgcggcgtcgttggagcgtgatggacagtcggctcagtctgcggcgcagcaggcggcgtcggcgaacctgtcgtccggtgggctggcatgtgcgccgagtgtgagcgtggacacgtcagtgtttgcccgtcctgccgggcaggcgggcacggttcacgccacggtcacgtgtgtcacctcgctgggtcttggattcgggtcccggacggtgcacgcaacggggtctgccccggtagacacctatcgggaaaggagaggctgagatggcccgcgatgagcgtggtggcggctcggtgtcggtgtggatgctgctcatggtgccagtaattctggtcatggccggcctggtttttgacgggtcccgtcagatatcggcaacccaggcggcccaggacgcggcggttgcggcatcccgcgccggaactgatgcggcagcgacaccgcagctagctggccacgacggggcggccgtagcagtccaagcggccc

SEQ ID NO: 337 - DNA, 1630 bp, Propionibacterium acnes
tctgcccagcgtttctcggcgatgtcgatcatgtcttggatggttttgacccatcctcggatgggatcgactttggtcagtttgatcccttcgaggaactcgatgggctgggtgatgggcccatctggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatggtcttgacgacgattcggttgtggcggatggggccccatgcatcagcggggacttgccagccgtgattggcggcggactcggtgatcttgaggcgtcgctcaggtgcgcgggtgcgggcagtgacgtcggtgttccaggtctggactggtacccacgtcccctctcggatgcgttcgatgacgcacgtggtgacctcgtcggtgactgtgatgaccagacgataatctttcccgtctgg

SEQ ID NO: 338 - DNA, 1643 bp, Propionibacterium acnes
gcgagccacgaccatcgccaagctgaatggagagcgagcatgagcaccacccctgccgggttcgacttcgacgctctggccgagtgggccgagagcgatgaggcgacccacaccccgcaaaccagccccgtgttccggggcaaggacgccgcgcgcgccagccgcgcattcctcggccgaggacggcccaccctcggcgcggaccacgccaccggcgagggccggtcgccccgccgtcaagtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcctgctttccggtgctgtcatgagcgtctgacaacagcgacacctcggggcagccgacggacagtcctctggctgccgctctgatcccatgcccacggcacgaaggtgtcggacagctcggtctcatcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaccgctgacccgcctggtcctccagccacgacaacgcatcccgaaacagcccgacgtcttccaaagctaaaccacagtcgtagccgcccttgtcccccaaccgcaccatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacgatgatgggggaggttggtgacctcatggcgcagcaggttgcgcttgtgcatctgctggtcgagacggtcgggctgacctgttgacggggttgagccgtggcgccgcttcctcggcggggtctcgatccgttgctcttccggcggttcggcgtcaggttgtggtgcgcgatctcccctaggacgggggggcttgccacctatatccgagggacgatgagacggccttccacgcttgctgcgcactttcgcagcccgccccttgcggtcacgccgacgcggcggcggagtgacgtcctcaccgcgcgctaactgcgtcaacgcctcgaccaggttggtgcccggtttcagcccttttagcacgaaccgcaccaggcgg

SEQ ID NO: 339 - DNA, 1583 bp, Propionibacterium acnes
gaacggggcatgggattagccgaggcgctgcgcgaggggacggcccttcccccaccacagcatctcagcgaaaacctccacctggtcagtggcggcccggccctccacgagttcaccgaccccgcatccttagcggccatcatcgaccgagtcaccaccgcacgctacgacctgctagctcaggcccttgccccgctggcctgggactatgacctcatcttcatcgactccgggcctgcccaaactctgctgtcccagaccatccttggagtagcccgctggctggtagtgcccacccgcaccgataacgcctcaatcactggcctcgtcgacgttcaagacgccatcgacggggttgcctcctgcaaccctgaccttcaactactcggcgttgtcctagccggcgtgggggcccgggccacccggatcgccgcagataaacgccacgccatcgacacagtgctgggggcaggaaccgttttcgatgcggtcatccactactccgagaaggtgtccgtgctcgcacgccagcagggcaagaccgtcgccgagctagccaacgagtaccacaacacccagcccgcctacacctacctagctaaaggccagaacatccccaacgtcgccaaggcagccgtcagcatcgaaactgattatctgaggctggccaccgagatcagcgaccgcatgttcaccagcgacgagcaggagcctgatcatgactgacgatccgactccatccgagcagaacaaccccaccagcgacgacatgcgcttggccgaagaatgggccaacagcggccgcacagtgggagccctgccgcgccgtcaacggcctcagcaacccacaccccgcaccaccagccaaccccctgtctcgtcccctgacacaccggctccgaaaaaaccccagaagacccccaccagccagcctggccgtcaacggatcaacgtcaccgtctacgttgtgcccgaactccatgagcggctgcgctcccgatcggcggcgacgggggtgacggtctcggatctggtggtgcatgcgttagcgttcgtcgccgatcatgcgggggaggcgatcgccgatgatctgcgcgtcgagacgggccccggcatgggggccggactgttcgatgtgaccccatcgcggccagtaggggtcgccaaaacccagctgggggtgcgaatgacccgccacaacaagaatggcttggaccagctgacccggacgagtggagcccgtgaccgcagccatcttgtgtctgtcgccgtgcgcgactatctcgactccaaccctgtaaagaaaggccgacatgtccgctgatgaaactcctgccgcccggggtgggcgacgctttgatacgaccgtcaagcccaggcgccgtcccatgcttatcgccgccggtatcgccatcgtgatagtcggcgcgctcctcatcactcagttgattcgctccgcccaaaccgagcatcgcgtgctggaagtccacgccgatgtggctcgcggcgaggtcatccgtgacaccgatctggtatcggtgactgtcggccaggtcgacaacgtatcaacggttcccgcagac

SEQ ID NO: 340 - DNA, 1551 bp, Propionibacterium acnes
gctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgaggactcgcgtcaggcagtagtccgggaagtgcacgaagagctcggcgtctcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcggg

SEQ ID NO: 341 - DNA, 1546 bp, Propionibacterium acnes
gctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccctgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgccgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaagg

SEQ ID NO: 342 - DNA, 1496 bp, Propionibacterium acnes
gggaatacagactcttcgactggaattaaaatggtatatggcgtgtccggtccgcacccagctccacgatgcgccataggggagccataacttcaccaatcgtatacgatatgagtgtgggtgagcatctaccggtggccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggactggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcgccgaggcattcatgctgccaggcggcaagccggagcccggcgagaactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgatgacctggccccgctgctggtcgaggcagtcatcccgtggctgcggcgccgtatccggtcggtcgctgtattcacgggtgcgaaggatggaaccgaccctcattatcgtgtcgaagcaaccgccttgggccggggtctcgcacacgccgggatcaccctggtttatggcggcgggaaggtcgggatgatggg

SEQ ID NO: 343 - DNA, 1526 bp, Propionibacterium acnes
cgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccaccaggcccgagacaccctcacccacgacaacccccatgaacgccgcctggcccgcgaacaccaccgcgcccaactcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcagcatgtcaggacacactgatacccgctcatacacacaccatgaaacacgacaagccacctgacagtatcagctgcaagacgcatgacaacatagaaggatatgatgaaatacacatagacacaacccagcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaa

SEQ ID NO: 344 - DNA, 1473 bp, Propionibacterium acnes
cagatcactagtcatggcggggtgcgtgatacccggatatcggtcagtgatgacggggccactgtcacggtgaccgtctcaggtcgggccccatcgatgctggggctgcatcttccggctgtgtcgtcgacagcgtcgatgcccaaggagcgcctgtcgtgaggcgaagtgagcgcggtggagcaagtctaagcgtcgaggtgctcatgtgggcgccgatcgcgctggtgatcatcgggtttgttgtgggtatcggccggatgtcgatggcccaggacgcggtgaatggcgcggcgggtgctgcggcccgtgcggcgtcgttggagcgtgatggacagtcggctcagtctgcggcgcagcaggcggcgtcggcgaacctgtcgtccggtgggctggcatgtgcgccgaatgtgagcgtggacacgtcagtgtttgcccgtcctgccgggcaggcgggcacggttcacgccacggtcacgtgtgtcacctcgctgggtcttgggttcgggtcccggacggtgcacgcaacggggtctgccccggtagacacctatcgggaaaggagaggctgagatggcccgtgatgagcgtggtggcggctcggtgtcggtgtggatgctgctcatggtgccggtgattctggtcatggccggcctggtttttgacgggtcccgtcagatatcggcaacccaggcggcccaggacgcggcggttgcggcatcccgcgccggaactgatgcggcagcgacaccgcagcttgctggccacgacggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgcttgtggtgatagccggcttaccggccgggctcgtggccgcaggcgccccgctagtaccggcgggcctgtcatgggcccatgtgcggcatctgttggttaccccagacatgaccgggtcggtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcggg

SEQ ID NO: 345 - DNA, 1515 bp, Propionibacterium acnes
aaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacagcagtgccgactttctgctggtcggcggcggtgcgagggaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggtgccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcctcggtggcgtaggcatcattgttgacctgatccagagtcccgtaccagcccggcaggatgcgctgctgaaaggggccggcgtcaccgtcaccgttagccttcgctgaggtagggtcggccccaagatctgattcttgtttggcggtcatgatagcgatgaccgctgcctgggtaggcagtttgtcacgctggaccacagtgacgatggtggtcacgagctgcttctgcctggccgtgaggcctccggcacccacagtgcctccggtgacggtacccacgcaagcatccccgccgacactgccaccgccgccgccagagttgtcgtcgagggccccagagcctactgacagcagcggcacaatgatcacggtcgctggcaagaccgccaggcccgccagcatcagcactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtgacccgtcgttgccctcaccggtgcatc

SEQ ID NO: 346 - DNA, 1791 bp, Propionibacterium acnes
aagggtggcctggtacccggggaacccgcacccgcgaccctgtcgaactacgccaccggccaggccctcaagaactacatgaccttcatgcaccaaatctcgggtctaggtctcacatggaagtcgggagcctcaaagatcactgtggtgcgggagaaaaagggtgataccacctaccccgaggccgctatcgccttggaatcgtgcgaagacggcagctccatccgatcggtggaccgccacggacaggctgaccatggccggctcacacacgtcgacagttggtatgcccgcgataagaagggcaccatcaaaatgatcgcacgtaacggagtggaggtttcctcatgcgacgtcaagtaatcaccgcggccgtgctgggcctgaccctggccaccacctccctgcccgccctcgcagataatggagacttcagtggccatacagacacggatggtcctggttacgatgtgcgtactgaggtggattaccatcacaccaccggtggtgcgggtgggggtgccacgacagggggccatcatgggggcaaaacccacggtgatggtgaaggtgaggctattgatgggcgttctcgcgccgatgccgaagccgaactagacgaagccgaccgtaaccaggacttgacttgtgatgtcatgctcccaccggcgccgaataccccagccggccaggaatgggcgaaagaatgcaatcccccagcgaaaaaggggcagaaggccaccccgaagcccgacccggtgttagtgggccgtcacgcagccttgcagctcacccttcccggcgcggcccctcgtatcgatccgtcccccgaccttaaccggtggcactcggcagcagtgggccaggctttgtggttgtcagttgatgaccccaccgccactacacagaaatcgatcacgtttatgggccaggttgtctcgttgagcgccaaacgtaacggtttgtcgtttgatatgggtgatggtcatgtcgtgcactgtgatgccacgacgacatggacggagtcggtggaaccggggaccccctcacccacgtgcggttacacctaccaacaggcagccccggccgggggctataaggtcaccgcaatcacgtcgtgggatgtgacctggtcggtactaggacacacgggcacagtccatatcgagaaggccggtgggcagatgcttccggtcggcgagttggagtctgttgttacacggcgatgactcctgatagtccgacgctgtatgaggtgttgggggtctgccctgatgccactgatgaccagatcaagacggcgtggcgtcgtgccgcgaaagtgactcaccctgatgccggtggcactagtgaggcgttcgcggccgcccggcacgcctgggaggtgttgtctgatcctgcccggcgcaccgcctacgatgccgacctggcgggggaggatgatcccgacgacgaagccgccgacgccttcgacgttgatccgttcacggcatggccctggtgcgccccgtacatcgacgccacccccaccctgcgccacacctgccccggcacgatcaaggccatcgtggtcgccatcgccgggatcatggccggaatcggctggcaggaagcgctggaggccgtggtgtcgccgccggggtttctgggggcgtgctggatagtctcagtgccggttgtcgtcgcagtgacatggctggcagcggtgacgggtctggcatttttcaccatggcggccatctggtgtggatggtcgttgataggtggtgcgttgctgtggggccagacgtc

SEQ ID NO: 347 - DNA, 1079 bp, Propionibacterium acnes
caggtgggtttgaccgccagcgtcggattggtgctggtcgctgggctgatcaccactctcaaccgtcgttaccggacccggttcacccgtcagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgtgactggtccgacgaggtcaacgtcaccctggtcggccaggtgtgcccgggcctagaagacgcactagagtctccgaccctgacccgcgccaccgacgtggacgccctcctcaccaccctggaagctcgcgccgacgaccagcgacacatcctcaccgaaggaagccccctcgccgctcaccgagccgaccccgccatctccgacgggttcgacgccgaagtgatcctcctcgacaccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacgtggctcccctcggctggcacatccacccccaaaccctctcccccgacctgtacaaccgcgtggttgaactgctagacaactctgcggccgacgactacgcacccgccgactggtgggaccatgacgccga

SEQ ID NO: 348 - DNA, 593 bp, Propionibacterium acnes
gctgagaaaaattttgggtccgccctgcatatcggggcctcttcataccttcaaaagtgtgaagggaatacagactcttcgactggaattaaaatggtatatggcgtgtccggtccgcacccagctccacgatgcgccatagaggagccataacttcaccaatcgtatacgatatgagtgtaggtgagcatctaccggtgaccgacagtcagatacaagcatgggcggatgaagcagaagctgattatgacctcagcatgcttccgccgtctcgacgtggtcgcccaccggtggggaggggcccgggcactgtggtccctgtgcgcttcgacgcggacactctcaaggcgttgtcacaacgagcccatgacgaaggattgaccacgcgttctgacgcgatccgtgctgcggttaaccagtggctcggcctcggctcgtaaacattatcggcgcgacaaccttactgatgacgctgttggttacgccgtagagcacatcttgtactcgtgggcgctcgacgatgctgatgatcctcgttgctggatgatgattcggtgttgacccagctggcctcctcatggagctagttatcc

SEQ ID NO: 349 - DNA, 1791 bp, Propionibacterium acnes; identical to SEQ ID NO: 346

SEQ ID NO: 350 - DNA, 1079 bp, Propionibacterium acnes; identical to SEQ ID NO: 347

SEQ ID NO: 351 - DNA, 593 bp, Propionibacterium acnes; identical to SEQ ID NO: 348

SEQ ID NO: 352 - DNA, 1515 bp, Propionibacterium acnes
tggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgcatgggcctcgtaggagtagctcttaggtaggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatcggtgcatcgatatacctatgtatctgtctgtggtttttagaggccactcccgtcgccccgggccgctcagcgataccgcaaggctgtgtgggatcagctgtgccgctcccccgacatggcagacagcaccgttgcatgagaactgactgacactgtggcgccgcggaggtctcccgcggcgtccgctggggcgagtgcatgcctgtcagctcatcttttatcgtcatgtttccccttgtcagagcggtctttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgaatgggaccagattcgcgccactgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcgggtctgtggg

SEQ ID NO: 353 - DNA, 1766 bp, Propionibacterium acnes
ttaactagggtcattgtcggtgaggtgcgcggcaatgaggcctcggccatgttccaggccatgcagtcgggtacaggcaccatgagcagtatccactccccgcgagcctctgaggtgccgtcccggctagcccaaatgatttcgatgggcccggtctacgatctggatcaggccatgctgcagatcggtcattcgatcgactacatcgtctttgttcgtaagcgtgacctgcctgatgggagccggctgcgatttgttgagcagatccgttcagtctcgcctggtgattcgacaactcccagtcttggcgaggtgtacacggctgactcgtggacaggccagccgcttacgccactcatgcctggttcggccgccgacgagctgtctcacttcgcccgagacctggattactgcgaggcccactcatgaacactcccgcactaaccagcgccctcatcgtgaccgggctagggctgatcctggccatcgacgggctggtcccggcgccgcctcgacctggtgccccgctgagcccggcccaaaggtgggctcggctcacccaccgtcccactggtgcggccgggcgtcgccgggatttgcgttgggggttggctgttcttgtcggtgtcgtgctgtttgtgctcaccgggtgggtggctgcgctggcgctgggccccatcattgtgttgttggcccccaccctgctgggggcggccccaccgaccgatattccgctgatggaggcgctggatcggtgggtgcgtcaggtcgctgcggtgctgccacaggggcgagacatcatcacagcggtgcggatctcacggccgcgggccccgaagctgatcgccgggtcggtggatcaactggtgtcccggttggatggccgtatggagccgagggaggcgttccagcggatggccgacgagctggactcggctgaggctgacgcggtgctggcctcactagcgttggcggccactcatccgcggggagcctcgacaacgttgaaggctattgctggcaacatccaacagcggttgaaagtgctgcggcaggtggaggctgaacggtctaagccgcgtaactcggtgcgccagatcacactggtcacgatcgccatgttcggggggctgctcgtgatcggacggtcgtttctggccccgctggcgacccctcccggtcaggtgctggtggccgtggcggtggtcatgtatgtcatcgcactagtgcagatgtatcggatggcgcggccccgtcgacgcacccggatcatggtcaggaggacccgatgaccattactgctttgtccctgctagccggggccatcgtcactgtcggactgctggtcatcgtggcagcgttccgcccagccccaggccctgacctggttgccgctctggaggtggtgtcgggtcgcacctcaagcgtcgccgagaacgtcgaccagacccggatcgggcggataggtcgcagcgtgacccgcacattccatgtgtcggtgtccccggccatgcgggccgcactgcggctccaaggcacgacccccgaagcgttctacggtcgacgcctgatctgcgcactgatcggggcgatcctgccgtggctgctcaacgcggtagccatcgcggtaggggcgaattccccgaacctactcatcccttcggcgctgtgtgtggcgttagctggcgctggatggatgctgccggcagcacggttgaaggctgcggccgggcccaccaacgatgactcgttcgaagcgctgctgg

SEQ ID NO: 354 - DNA, 1453 bp, Propionibacterium acnes
catccgtgacaccgatctggtatcggtgactgtcggccaggtcgacaacgtatcaacggttcccgcagaccagctcgactcactggtcggcaaacgcgccacggcagatcttcgagccggatcactcttgcctgctggggctatcggcccggccgatgtcgttccagctccgggcaagtcgctggtcgggctgaagctagccgccggacagatccctatcggagaccttgctgccgggacgaagctgcgcctgatccagacgtcggcacccagcggctcatccaccaccactgatagcagcaccaataccgatggccagtcgtgggaggcaacaatggcgaccggcaccaaaaagaccgagcaggtcaccttgatcaacgccgaagtgaactcgcgtgatgccgcccggatcgcccaactgacgtcacagggccgtatcgccgtagtgaaggatccgatccgatgagcaccattgttttgaccagcgtctcgggagccccaggggtcaccacgacagcgatcgggctgggcagggtctggccacaatcgagcctggtcgtcgaggatgacacccaccacgccatgctggcgggctacctgcgagcctcccagcacgccgaaccgaacctggccgcagtggcgaacctgacgtcgactccaaccaacgcccaaacggtgtgggaatctatcgccagacccctacccaccgatgacccagtcggcgggctgcgacgcaaaggcatcctcggcccgcccacgccgtggtctcgcgcaggcatcgacccccgatggggattcatgctggccctgtggcggcaactggaggaggctggcatcgacaccatcatcgatttgggtcgcctagccacaccactgacctcaacgccacacctgatcgccgcacccatcgtcgaggacgccgacatgatcttggtgatgatcgaggcgacactacgcggcatcgccggcgcccgcacgatggtggagggactcgctgagcagatgaacttggccggcgcctaccgacgtctcggactgcttgtccaccgtggcggccaggcccgcggcgtcgccgagttcaatgacaaggagatcacctcggcgttacgactcccggtcatcggggccattacccacgacccggccggagccgcccaactctccgacggggtcgggcagcggttcgacaagtcacgtctggcccactcactatcaaaggtggcggccagcctcgtcgatgccataaacaagcgccacgctgatgacgaggaggatctgtgatggccagttttgctgataatccgttcgacaagctgcgctcccaggatgcggcaagagcttcggtagagcaggagcctgatgccggattagcgtcggagttgttttcgacgtcgtcggggtgggccagctctcagcaggtgtcccaagctcaaccggtgatgacccgttcgga

SEQ ID NO: 355 - DNA, 1466 bp, Propionibacterium acnes
tctggggagtctgggcccggaagggccacgggtcggggcaccatcgagggcagggggtggcggcgggtgacggtgatggtgtcgtgttccaggtcgaagtcgctgcgccactggccgagcatcatcgccgaggtcaccgcggccaggcgcaattggatgttcgggctggacaaatgggcgccacgttggtggtgaatggtgaagccgtccaggttcccccgatcggttttccaggaatcgacggtgaccgccgacccatagatctgagtggctacttctttagcccgttccttgtctcggtccagatcggttttgtcagggtcaggggtcggggcgcggtattgcaggacgaaccggccggccgggatcgttgcggatgtcaccgtgaactctgccggcgaccaggcagccgcggccgcctgggtgagggccattggcatggtctcgacggcagcctcctcgggggggatggtgagggtcaggcgtcgcggatgcgtcttcttgcgattccatgtgactttctgcctcaccggcaccttcgccgccgactgaatggctaggcgagctgattcggcagtttcggtacgccggccagcgcgtagcgcccgtcgtgcgtgaaggctgcccaccacagcacagcccatacacggcagccaccagcgcggatcagcggctgctgcatagcccccggtagctagtaccgcacctgaccagccggccgcgatacttttccacgccggtttcgcgccaccaggaccagcgttatggacggtctgcttcgaggctgcggagggacgagacagcggagtgctggtcatgccgcggcctccttgtggcaggtcatttcacaggcatgccggccagcgatgatgccgtggcgcaccgccccggtagccgcatagaccgcgcacaactcaaacacggggcacccatcgcaggccgccgggttcatgctttctttgtcccacgatggtgggtcatcggtgcacggcacggccaggccatcctgttgagcggcgctgatagcggtgaataggcgcagctgggcgcgaacttggtctggggtcaggttgacggtgcgggctacacgcatggggttccttcctcttcaccagtgaaggttccctagacccggccgatgtgcggagggatttcagtgttttatcgaggtgaccagccagccggtctgcgctgcgggttcaggtaccagggtcagatgcagcatggtgtggtcggctaggggcacggcgaccaggggcccgtcggcgctcgccccggtgagggtgggagttccggccacggtggtggcgggaatctggttgggtttcgcggccatcagggagcccatgagggtcggggcggcgatctggacgagggcgactttgcgggcggcgggatcgcgggtcaaccagccgcgggtgaaggtgagcgcagccgacgtgatatcggggctcagcggggctggt

SEQ ID NO: 356 - DNA, 908 bp, Propionibacterium acnes
ccccaatgcccccacaacgatcagcacaccaacagcgatcatcaggtgggcagcactaactgatcccaacggaccaagatcaaacaagccctgcccgggagcgccgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggttctgtgggaaaaatgcttcccattggtccgtcttagttaggaaacttggcctaagtgctgtcgagggtcgcgtgttcgtgaccggttcgaagacactgccgccttgccttcttgtcagtggcgtttccgagatggggtcagtgggcgatggctaggccgatgagggcgccgctgcacaggctgggtgccaggggaggaatcgggtggtgtggtgtcggaaccggtcgattagggcatatagggcgatcagggtgaggccggctatgacagtgacctgg

SEQ ID NO: 357 - DNA, 1602 bp, Propionibacterium acnes
gacgccttcggcgtcgggtgagcgcgtggataggcgccccttcggggcacctgtaagcctgtatcgctgcggtttacagccttggccacccgaaaggggcggcaaggggccaggaggggcattctgcgccgctgatggcatctcacatgtgagttattctctcaactatccttcaagtcaagcgtattagattatttatccagtactcttgacagtctgtctatcgggctatatatttataagcagaacgagagatcgggaaaggaatcaacgatgaagtacaccgcacacgtcaacatggtgaccaagccctacatcggacttcccactacccgaaccccctacaccctcgtcgacgccgactgggccacaacatggatgatcgacgaaacctacgaagcccactaccacggcaccagcgtggagatcagcatctacggcgaaggccccgactgctccgtactcaccaaccgcatctacaccgaccagcccaccgatgtgaccgctgcactcgccgactacggcttcaccatcgacaccaccaacacatccaaaaccatcctcacgctcacccgcacagccaccatctcccacctgctagccatcctcgatggcctaccccaagctgaggggactcactggctcaacactcaacccgacctccaccacatcaccctcgacgactccaccaccggctgggccaccaaccgcaccgacgacaccgacaccggcgtctgctacgacaccagcacccacaactggcagatctgctgacagcatgacgggcctgcccttgaggggaagttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactcccccaccctcgtgtagtacattgtactatagacgtcttacgaggtgacaccatgagtttttccatccgtttaaccgaccatgagcgccgcttagctgattcctacgcccacctacactcgcagtccctgagtgaggctttcaagcaagccctcttcgaccgcatcgccgacgagttcgatctgcaagtagcccgtgaggcactcaccgactacgccaacgacaactaccagtctcgtcccatcagcgagctatgggacgagtgtgacctatgacttggcagatcgaaaccactagccggttcgataaagaattcaaaaagctagaccgctacacccaaaaactcattcacggctggatcacgaaaaacatcgacaacaccgacgatccccgccgccacggcaagcccctcaccggtgatctttctggactgtggcgctaccggatcggtgattatcgcctcatatgcacactcaacgatgaccgcctcatcatccttgccctgtccatcggtcaccgccgcgacatctaccgataagcc

SEQ ID NO: 358 - DNA, 1452 bp, Propionibacterium acnes
cgctgatgaggctgccgagttggcgtggcggttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccaccaggcccgagacaccctcacccacgacaacccccatgaacgccgcctggcccgcgaacaccaccgcgcccaactcatcgacgaccaactccgccgccgcgcagaaaccgccacctgcgcagcccgcctcgcagccgagcacgccgaccccgactaccagacccgccgtcgtgaacgcagggaaaccctgcgagccacactcagggccgcccagcag

SEQ ID NO: 359 - DNA, 1595 bp, Propionibacterium acnes
cggcgtcgggtgagcgcgtggataggcgccccttcggggcacctgtaagcctgtatcgctgcggtttacagccttggccacccaaaggggcagcaaggggcccggagggggcattctgcgccgctgatggcatctcacatgtgagttattctctcaactatcctttaagtcaagcgtattagattatttatccagtactcttgacagtctgtctatcgggctatatatttataagcagaacgagagatcgggaaaggaatcaacgatgaagtacaccgcacacgtcaacatggtgaccaagccctacatcggacttcccactacccgaaccccctacaccctcgtcgacgccgactgggccacaacatggatgatcgacgaaacctacgaagcccactaccacggcaccagcgtggagatcagcatctacggcgaaggccccgactgctccgtactcaccaaccgcatctacaccgaccagcccaccgatgtgaccgctgcactcgccgactacggcttcaccatcgaagccgccaatacatccaaaaccatcctcacgctcacccgcacagccaccatctcccacctgctagccatcctcgatggcctaccccaagctgaggggactcactggctcaacactcaacccgacctccaccacatcaccctcgacgactccaccaccggctgggccaccaaccgcaccgacgacaccgacaccggcgtctgctacgacaccagcacccacaactggcagatctgctgacagcatgacgggcctgcccttgaggggggggttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactcctccaccctcgtgtagtacattgtactatagacgtcttacgaggtgacatcatgagtttttccatccgtttaaccgaccatgagcgccgcttagctgattcctacgcccacctacactcgcagtccctgagtgaggctttcaagcaagccctcttcgaccgcatcgccgacgagttcgatctgcaagtagcccgtgaggcactcaccgactacgccaacgacaactaccagtctcgtcccatcagcgagctatgggacgagtgtgacctatgacttggcagatcgaaaccactagccggttcgataaagaattcaaaaagctagaccgctacacccaaaaactcattcacggctggatcacgaaaaacatcgacaacaccgacgatccccgccgccacggcaagcccctcaccggtgatctttctggactgtggcgctaccggatcggtgactatcgcctcatatgcacactcaacgatgaccgcctcatcatccttgccctgtccatcggtcaccgccgcgacatctaccgctaagcc

SEQ ID NO: 360 - DNA, 1388 bp, Propionibacterium acnes
gggttgccatcggaataccgtggaccatcccggcgcatacacccagacggtccaagatccaatccacgctcacccgcgacgccgctaacgatcctcatacaccgtagatgccgttctgagagccttccagacccgcacgtgggtttattgcaccgagacccaaatcccctcagaagcgatcctgaaaccgtctacgccccatttccgacggacgctggacaggctgggcggcttgtctcccgccgcagacatggccctggcatatgcggttgccgactggtgggatcagggattggatcacacggcagacggctggtccaaggcgggtgtgcaggtgcggtgagcggcagacgtgaccggtggggtgcactgtcatggccgggcatctgccgagccaccatgcgggccctggaccaggaggcagcccgctgcgaggactgggggaagacggcggcacggatgggccgtcgggatgcggcggccgaattcaccgagactgcggtgcagcatcgtggacagatgcaccacctcatgtcggcacaaaaagtgtgggtgtcgaccgacatggtgtcggctacactggacgccgcaggagacgtgccgagtttcgaggccgtcgacgtccctgccgccgggctcatgggtttggccagccccctgccgccggttaccctgcagcatccgctgtatctgcgcagcgacgagggtgtgacaaccttcactgatccggttctcgtcgacgcgctgggatggtggatggattctgggcgtgtgcacgtggtgatgtgcacacgcacaccccggctgcccaacccggtttatgcggtggcctccccactgacggtggtggagaaaatcacggtgcccaccggcatcgagttcgagaccatggagtccaggatcctgacccccggcggcgtgacaggcgtctcacggcagggcacacgcatgatgatccggttggcgtcatggctgggtgccgcgtgggtgctcatggcgactccgacggtgtcggagccgcaccctatggatggccggtggggaggcccagcaacggggcagacccggccgcgtgatcgggtgaccgtggtcgacatgcggcccatgaggcaggtgcacaccaccaccgaccccaccggcaggcggttgacgacccggcatgtcgtgcgaggacactggacacaccaaccctacggcccggcccgcagtctccgacgcctgcagtgggtcgccccattcatccgcggccccgaaggggctccgttcgtcggcaccgacaccgtcaccgtatggcgccgctagatacgcgggcgcggggggttgacgaacgatgcccccctctttgtgttgtgatcagtcgtgatcggcgggttttaggtcggggtagg

SEQ ID NO: 361 - DNA, 1578 bp, Propionibacterium acnes
tggataggcgccccttcggggcacctgtaagcctgtatcgctgcggtttacagccttggccacccaaaggggcagcaaggggcccggagggggcattctgcgccgctgatggcatctcacatgtgagttattctctcaactatcctttaagtcaagcgtattagattatttatccagtactcttgacagtctgtctatcgggctatatatttataagcagaacgagagatcgggaaaggaatcaacgatgaagtacaccgcacacgtcaacatggtgaccaagccctacatcggacttcccactacccgaaccccctacaccctcgtcgacgccgactgggccacaacatggatgatcgacgaaacctacgaagcccactaccacggcaccagcgtggagatcagcatctacggcgaaggccccgactgctccgtactcaccaaccgcatctacaccgaccagcccaccgatgtgaccgctgcactcgccgactacggcttcaccatcgaagccgccaatacatccaaaaccatcctcacgctcacccgcacagccaccatctcccacctgctagccatcctcgatggcctaccccaagctgaggggactcactggctcaacactcaacccgacctccaccacatcaccctcgacgactccaccaccggctgggccaccaaccgcaccgacgacaccgacaccggcgtctgctacgacaccagcacccacaactggcagatctgctgacagcatgacgggcctgcccttgagggggggggttggactctgcacccatttcagccgggtacgttgccggctgggcgaaggaagcagacggcgccgcgattgaagctgccgccgagcacgtcgcgaagacctcccacgcgattgccgaggcgttgcagctcaccgcacagtgagccccacggggcgaccggctcaccccggtcgcccctcaccccccgacaggggaaccgttcccgccgcctgaatctccatacccctgatacgtactacgcggggtcgaggagtggactcctccaccctcgtgtagtacattgtactatagacgtcttacgaggtgacatcatgagtttttccatccgtttaaccgaccatgagcgccgcttagctgattcctacgcccacctacactcgcagtccctgagtgaggctttcaagcaagccctcttcgaccgcatcgccgacgagttcgatctgcaagtagcccgtgaggcactcaccgactacgccaacgacaactaccagtctcgtcccatcagcgagctatgggacgagtgtgacctatgacttggcagatcgaaaccactagccggttcgataaagaattcaaaaagctagaccgctacacccaaaaactcattcacggctggatcacgaaaaacatcgacaacaccgacgatccccgccgccacggcaagcccctcaccggtgatctttctggactgtggcgctaccggatcggtgactatcgcctcatatgcacactcaacgatgaccgcctcatcatccttgccctgtccatcggtcaccgccgcgacatctaccgctaagcc

SEQ ID NO: 362 - DNA, 1665 bp, Propionibacterium acnes
ccccaatgcccccacaacgatcagcacacccacggcgatcatcaggtgggcagcactaactgatcccaacggaccaagatcaaacaagccctgcccgggagcgtcgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggttctgtgggaaaaatgcttcccattggtccgtcttagttaggaaacttggcctaagtgctgtcgagggtcgcgtgttcgtgaccggttcgaagacactgccgctttgccttcttgtcagtggcgtttccgagatggggtcagtgggcgatggctaggccgatgagggcgccgctgcacaggctgggtgcccaggggaggaatcgggtggtgtggtgtcggaaccggtcgatgagggcatatagggcgatcagggtgaggccggctatgaccgtggcgtggatcgtgtcgatgccggttgctgcggccggggctgcccacagtggtgtgatgcgcacgtcggagaagccgaagccgcctcgggagatgagccaggcgatcatccacgccgcggagatgacgacagtagcgatagcagcacgtatcgccgcagtctggttcgcgagagcgatcatggccacagccccgatccatccaacccagccggtccaggcgaggactgccggtatccatgtggtgatggcgtcgatgacggctacccatgccccgatggtggctagcagagcccaggccggccaggtgggtgctggggcccacgctacggcggcgatcatggttgtcgcagatgcagcacagacagcgatcatgcttcggagactgtaggtgtcgcggtaggcgattttgtcgggggtggcggtggccggttcgggcaggatgcgagtgagggcaggccatcctgcggtcgcaatggtcacgacggcggcgatccacacgatctgttgcatgggtctcatcatggcccaatatcgatgggtgtgggtggccgacatggggtcactcgtagaggggatcgaggggtgtgcgggcgagcatggcttcctgtgtgccgagcatgagggtgccagaatcctcgccggctgattcccagtcgacgatgatctgcccgctgtcgacgctggattcggtgatggtcacccattctccgtcgatattgatgagcaccccagcggccagctctgtggcagcaaccgggtgagg

SEQ ID NO: 363 - DNA, 1497 bp, Propionibacterium acnes
gataccgcaaggctgtgtgggatcagctgtgccgctcccccgacatggcagacagcaccctgcggactgactgacactgtggcgccgcggaggtctcccgcggcgtccgctggggcgagtgcgtgtctgtcatctcatcttttcccgtcacatttccccttgtcagagcggtttttgcaaagtgacaacgtcaggggtcttgacgacaacatcctcgacaacatcgtggcggtggtctgtgtctcgtcagttcaacgcaccggggaaagaggcaccgctgatgttcaccaccacaaacaccctcaacgatgagtgggaccagattcgcgccatcgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcggggttgtgggagacgatcatcacgtacccgttggatcgtcgccctgacaagatcgctgcgaacctcaccctcgacacgttgcaccgggttacccggttctggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcgatctcgatgccgtgatggtcgggccgtgttgcagcgcaacgccgagacgatcctggccgtctgctgatcctctcttgctcatgcctgccgccaccctacccctacctgctagaaacatagccatgtctccagcaacgcatctagcatatcgtctagcaattgatctagctatgtatatagctgatgatctagctatcatatagctgtgtctccagcccaaatgacagcccaatggcatgcttgccacaggaaggtgcgtcagcctcccgaaatactggaaggagctttaccgtgcaggacatgacctcgaccagaccgattgaccgatccccgttcgaccgcaccatcgcggtatggaaccacaaaggcggcaccttcaagacgtccgtcgtggcgaacctgggatacctgttcgccgccggtggcaacaaggtgctgctggtcgacatggacccccaagccaatctcgacatcgacttcggtacccccgccaatgagcgtgaacgaggcataggattagccgaggcgctacgtgaggggacggcccttcccccaccacagcatctcagcgaaaacctccacctggtcagtggcggc

SEQ ID NO: 364 - DNA, 1374 bp, Propionibacterium acnes
gacgggttcctgccaatcgatggttgacaagtcgtcggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaacatcaatttctcgacagctttcatgaggtccccggcggcaaccgcatccgcctcatcatccgaggagaaccacttcaggtctgaacggctgtacatagcccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacg

SEQ ID NO: 365 - DNA, 1569 bp, Propionibacterium acnes
gcccatccggtccaggcgaggactgccggtatccatgtggtgatggcgtcgatgacggctacccatgccccgatggtggctagcagagcccaggccggccaggtgggtgctggggcccacgctacggcggcgatcatggttgtcgcagatgcagcacagacagcgatcatgcttcggagactgtaggtgtcgcggtaggcgattttgtcggggctggcggtagctggttctggcaggatgtgggtgagggcaggccaccctgcggccgcgatagccatcacggcgaccacccacacaatctgttgcatgggtctcatcatggcccatcaacgccgaaaatgggtggccgacatgggttcactcgtcaagaggtgtacgggcggccgtggcttctcctgcgccgagcatgagggtgccagaatcctcgccagccgattcccagtcgacgatgacctggtcgccgtcaacgctggattcggcgatggtcacccattgcccgtccatgttgatgagcatcccggcggccagctctgtggcggcaaccgggtgggctgggctgtagaggaggtcgatgtcgcgggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgccgcggccgcgtttgccgaacgggattcccacgccgacgtgttcggagccgaacatcatgcgggctccgtcagcagacaggggtccggtggcggcacgcccggagaagttgtctcggatttcgccgcccaggaactcggcgtcggggcgttgggtccccagatcgacgtggatacggcaggcagctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctcccagtctggggagtctgggcccggaagggccacggg

SEQ ID NO: 366 - DNA, 1390 bp, Propionibacterium acnes
tgcccagcgtttctcggcgatgtcgatcatgtcttggatggttttgacccatcctcggatgggatcgactttggtcagtttgatcccttcgaggaactcgatgggctgggtgatgggcccatctggtccggcttcggtgtcccagccttcgtcgatggctagtttcagttcggcggtatcgacccatgtttcgtgggtggtgccgggcacgttgggccaaaaccatcctgctcgtcctttggtgcgtttgaccggtagtaggccgatgtcgtcccaccaggatggcacggtgaagcggatgtggtagcgggccgggtgccaggggttgttggtgaacaggtcgcgggcttcggtggcgctgagcagagtggcgggtgcggcaccgatctctccggtcactgatccggcatacatgaatcggccgtcgatgtacacgaagttagggatagggccggcaggcacggtggggcgccagcccttttcgcggtcctcggggttgccgtcgtcgacgcatagttcgtagcggtgctgaggggaggtgtgttggatgagtgcgcccagttcggggtccatcggctccatgcgataggactcgggggtccgtagcttccagaggttgattccttctgctccggggcggtccatgagggcccagtcgcggtcgattctggtggcgatgatgtgggttaattcgcgccatgcccagcgggcctggattggggtgagggtctggccagggaaccattcatcagcgaccagaatgtcgaggttgcggtcggtttctttgtgggtgaaccggcctcgggcgggccgcccggacagcatgaacaggccccgcacgtgccagtcctggttgaactcgcgggtgtgagcgggggtgtcaggcagcagccaggattgaggctggtcggggatgttaccgcagacgatcaggcgtcgggcgttgtggtgtagcgcggttgttagcaggtctgacagggtcgcgtgcttggtgcgtcgtccccccagcactggcaggatctcgtttccggccgcgtcgactccccgggcggtgtcgatgtctagccacactgtttcggggtcggggggccgatgtggggcgggacggcgctgctcctggtcgtctctcatggtttcctcctttgggccagggagcggccggcgtcgagggcgttcatgcgctcgcgttgttcttcgcgtagttggtagacccggcctcgtgacactcctgctgcctcggcgatggtggtggccggcaggtggccgatggcggcagcgtcggcaaggacgtcacgccaggccaggtcaatggttcccagctgggctagagcttcgtcgcggcggcgggtggcatcagccactacggaggcccaccctgtggggtggatgg

SEQ ID NO: 367 - DNA, 1289 bp, Propionibacterium acnes
cttcgacgctctggccgagtgggccgagagcgatgaggcgacccacaccccgcaaaccagccccgtgttccggggcaaggacgccgcgcgcgccagccgcgcattcctcggccgaggacggcccaccctcggctcagaccacgccaccggcgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccccttctgggtggtggtccagggcgtcaccgccccggaccagttgggtagtcatctcagttgaaataagcgattagtgatacgcccctcatgctttccggtgctgtcatgagcgtctgacaacagcgacacctcggggcagccgacggacagtcctctggctgccgctctgatcccatgcccacggcacgaaggtgtcggacagctcggtctcgtcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcagcgacattgccgtaacgctgccccgcctggtcctccagccacgacaacgcatcccgaaacagcccgacgtcttccaaagctaaaccacagtcgtagccgcccttgtcccccaaccgcacaatctggcgctcccggtggcctccctcgtcgacctcgatccacagtttcgcgtgcatccgctggcctcggccctctgacaggatctcggtgagcaggtcggacgcctgccctcgcgcatcctcgttactgcgggggaattggagtatgtgggaggaacggtggtggggcaggtttgtgacctcgtgacgcagcaggttgcgcttgtgcatctgccgttcgagacgctcgggctgacctgttgacggg

SEQ ID NO: 368 - DNA, 1226 bp, Propionibacterium acnes
ccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtaaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttggggtctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacggg

SEQ ID NO: 369 - DNA, 1269 bp, Propionibacterium acnes
tagaccctctgctgagggcttcatcaagatccatcacgaccttattagtgtcggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggcccggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggtcgatggggccgtcgtcgatgctgaggtgggctctggtgaaggtgtcgaggagggcggggaacccctgtcgattttgtccacccacccctgtcgattttgtccacccacccctgtcgattttgtccgccaagtattagacaaaccattagacagtgaattagaccctgggtcgcgtcagcgtgtgaactcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcagttcgtggggtggtgtcctcagctggtaggggcaccgaagaaggtgcgtggccagctccgccagatggtcgctgccgagatccgccggaatccgggctggctggatgcgccagcgttggaggttgttgcccagcgggtacgtgctgaaggtgcgctgggggtccagcactgtgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacga

SEQ ID NO: 370 - DNA, 1195 bp, Propionibacterium acnes
gaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctgatcgaccgtttgacggatagcccgctgatttttctgcatcgcagcgtgacgggtccgggccactccccggatcgccacgtcgaccggcacgccagtgtcgtcgatacggcccaaaaactcgtaggcaggccacgtcatcgtgcggggcaccttacccagcacgatatgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcagg

SEQ ID NO: 371 - DNA, 1199 bp, Propionibacterium acnes
acccttccagcccagcaccacccactacaccgacacgatccacgaagctgaaaccgaacctcccatccccgtccgaaacatcaacgaactcatcaaccccaccaaccatgcatgaacgcacgatcgcctaccggccagccttcctgcgcgacgtgaagcggctcaaaaacaagcactacaacatgaacacacactcaaatgggcggtaaggtcacgaagtcgacgtggctgcctcacggatggcttcggcgagctcttggggtcgactccacatgggccagtggccggttggcagatccatcgcggtgaagttggtcaggtgcgcgacggcgctgaacatcggattgcctgctgcggccagctcgaggacctggacgctgggaatggagcagcagatcaacgtggttagtacatcatggcgagcgctattggacagcgcgacccgtgcccgggccacttgcgcgggttcaggaaccgcccgtgcccggaaccggtcaaggtgctcgttgctgaggccctctaaactggcctgcttgccgagagtatcgaagtcaggaagtggcagctcagctgtttcctcaggtagatctggtgcgaaggcacctccatcgctcatgggaccggagtccacccagacgatccgatggaccaactctgggtgcctgtctacaactaggctcaccggcccgttcgcgccactgtgtcccaccaggaccgcatcgccgcccatctcgtccaggatggctgagatggcgtcagcttggtcgtcgagcgtgcgcgtagtgcgctgggtgtcctccggatcgagacctggcagcgtcagccccacggctcgactgccagcagtgttcaataactcgactacctcgtcccaagcccaggctccgagccagtaaccaggaacgaggacgataggccgatgctggtcaggtcgcgatgttgaagtcatggagacatagttgcacagtgcgcggacaagggagtggcactatttctggcatgaatttagatctgggtgtccggtgaggcgatcagaacgcctccatgtactgtccgagtgtctaggatgcagcggacacagtcgagcagctggctcacaagtttccaggtgtccttctgcccctatgagggaagtcggctgctctcgcaacctttgagggctgctctggggtcggaaccagttacagatcgttcaagtt

SEQ ID NO: 372 - DNA, 813 bp, Propionibacterium acnes
cgattttgtccacccacccctgtcgattttgtccgccaagtattagacaaaccattagacagtgaattagaccctgggtcgcgtcagcgtgttagctcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcagttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggacgtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcaccgcgatgtgccaaatcgtgcgcaccgccctggaggccgacctggccgccggaacccggtgggaggaccgatgaggg

SEQ ID NO: 373 - DNA, 1204 bp, Propionibacterium acnes
ccggagtatctggacaaggccgtgctcactgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagatctagaagatccaaaagaaccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctccctgagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggggaggcattggctggtgtggcggatgctggccggtcgtactggtgtggctcaggcccctatgtccatcgtggctcggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggttgatggggccgtcgtcgatgctggggtgggctctggtgaaggtgtcgaggagggcggggaacccctgtcgattttgtccacccacccctgtcga

SEQ ID NO: 374 - DNA, 1288 bp, Propionibacterium acnes
ccgaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacgtggctcccctcggctggcacatccacccccaaaccctctcccccgacctgtacaaccgcatggttgaactactcgccaactccgccgccgcagactacgaacccgccagctggtggaaccacgacgccaacgacgagcccaccaccgaccccaccaacgaggaagaatctaccccgagcaggcgagcccgcccgaatatccgcctgaccaccctgaccggcggcatcgacctatccagcgtcgacatcgacgacatcatcgacgaagccaaccaggccctcgacaacaccgaccaggccaccaaccaggttcgtgtcgacaccgaccaacccggcaccgacacccccttccccatcgacgacatcgacccgctgagctccgaccatccggtcctatccatcatcggccaccccgacatcacaggtgccactggaaccgttgggcgctccccgtggcgctgccaacagttggccctctacatcgctgagcatccgggagcatcgggggcgactatcgccgatgatttggggctatcagcgtcgacggtgcgctcgattgctacacacctgcgacactggttgggagccgatgatgccggggtggcttacatgccggcggcgacgcgcggctaccggctcgatgagcggatcgtcacagatgtggacctgatcgacgctgctgtggccggggcaggcattaacaccgctgagacggccacactggtggccattttgaagctgggccgcggacgggtcttcgctggggttcctgactcggaacttcgccagttcagggcgtcgatgtaccacgtggaggcccgcatcgtcgatgctgccctccaagtgacagaccgggccctggaagccggggacctggggctggcccggtgggcgttgacccaagggctactggtgtctcccgatcatgaggacctggtcgccggttgtctgcgcaccgagtaccaggccggcaacatggacaaggtcgccgagctggtcgatcacctgtcggctaccgcacgccgactgggcgtcgacctcaacgaggacaccacccggatcatcgatacggtcacccacaccgacaggagagcgtcatgatctcccctgcactcatctccgtcaggaaggttcctatgcaccat

SEQ ID NO: 375 - DNA, 1239 bp, Propionibacterium acnes
aaaagaagaaacccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactagtaatcatccgagacagcgccacaccgaactgctgggtgcgagccaacggagtagccaacgtcgtcgtatcgcctgcgaacttcgccaccggggccgccaagaaacccaacgccagcgccgcagcaatcgccgcacgcgcacccgtagcccacgccccagccgtacgtcccctcatcatcttgacgaccacgcccacaccggcgcacgtcgtcagcaacgtcaacaccgttccaccccagctgtccgctcccagcggggccaaaaccttgtcgtggatatcgttctgcaaccccaccagcgggccggtaatccacccgacccagctcatcgccacggtccagtccaacaaccggcacagcaacgcaatgaccatcaggtacgtgttccaacacataccaataatggaggcccacatagccttcaacggggccgtaacgccaccatcgtccatcgacatctggtactgaaacaagtgaataccgttggagtcagtcacattgaaaccgtcacccatccagcccagccccgggcccgacgccatagcaggcacactgctcagcgccaccaccaaaaccagcgtggtgacgatgatacggaaccaccgctccccggccccggggcggcgtggatgacggctcacgctgtctcccggtcgtgctcgggcgggttggagctggcggcttcgcggtggggagcgtaggcaggtctcagtagtcgaatttcaccgacgttgccgtgctgatcggcgtacaggccacaaccggggcctccggggttgagggcaatcttgaccaggtcagcgaactcttcaggggacgttttagggtccacgcccaggaactcgacacctttctgggcgaggttgatgttgtcgcacagcaacacgatgcgatgctgaatgaggttgcggacggtctcgttggg

SEQ ID NO: 376 - DNA, 1232 bp, Propionibacterium acnes
  modified_base (28)..(28): a, c, t, g, unknown or other
gcatcgatatatctatgtatctgtctgnggttttttagagggcccactcccgtcgccccgggccgctcagcgataccgcaaggctgtgtgggatcagctgtgccgctctcccgacatggcagacagcaccctgcggactgactgacactgtggcgccgcggaggtctcccgcggcgtccgctggggcgagtgcgtgtctgtcatctcatcttttatcgtcatgtttccccttgtcagaggggtctttgcaaagtgacaacgtcaggggtcttgacgacaacatcctcgacaacatcgtggcggtggtctgtgtcttgtcagttcaacgcaccggggaaagaggcaccgctgatgttcaccaccacaaacaccctcaacgatgaatgggaccagattcgcgccatcgagatcgattggcatgactgccctgaactgatgcactgcatcgacgttgatgatgtgttggccgtcattcctgccgcccccgacgccatcttgggctacctcattgcccgggctcagggcggtgacgagttggccacccgcactatcatccaagcgttcacaggcaagcttattttgatggccacggccaccaaggtgcgccgtactaatgacggcttcaatgatctgttggcgggtctgtgggagacgatcatcacttacccgttggatcgtcgccctgacaagatcgctgcgaacctcatcctcgacacgttgcaccgggttacccggttttggcgtgctgattcccccgatgaggaagaggctcacggtctggtgcccttccctgacactctcatcgccccagagcccgatgaggacgtcacagctagccaggccatcgccttggcggtggaccgcaactggattaccgaggacctagcccgcctcatgagccatatttactgtgacggtatgactggagctgatgcgggtcgtctgcatggctgcgctccagctacggtgcggtctcgatgccgtgatggtcgggccgtgttgcagcgcaacgccgagacgatcctggccgtctgctgatccctctcttgctcatgcctgccgccaccctacccctacctgctagaaacatagccatgtctccagcaacgcatctagcatatcttctagcaatttatctagctatgtatatagctgatgatctagctatcatatagctgtgtctccagcccaaaatgacagcccaatggcatgcttgccacaggaaggtgcgt

SEQ ID NO: 377 - DNA, 1200 bp, Propionibacterium acnes
ccggagtatctggacaaggccgtgctcactgcgttgtatcccgatgggttgcccttcgacgaggacaccgaggagccgggcgagaatgccgggcaggaggagcttgcgatgactggatgagcccgaacatggttgaaggccgccccgccaggcgaccttcaatcaatggtttcggttgtcagctgcagccacccttgccaggtgctgtggttcttctccagaggaggagggaccgccatgaagacccagaagatctagaagatccaaaagaaccggtttcggctgttgcttcggtcttcatggtagctgatagcccgcgtcgttggaagtgcgacgacgccgatcctcatcggtatcgcaccctgaaacagggtgttgaacatgaaggattaacaaccatgacaagtcatgaggcgtcctcccggagggcgtcatgaccgctttaattcaagctctgccgacagctgaactgtctgctggacctggtgctagcagtccagctagaccctctgctgagggcttcatcaagattcatcacgaccttattagtgcgggcgtgtcggggaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctacgtccatcgtggcccggttcctgggctgttcttcgcgccaggtctctcatatccgtggggctctcgttgatgccggtctgctcggctgtgacgaggtgtcgggggcggcgagccgggtgtggttcccctcgatggccgaggagtgtgcagcggatcgtgaggtggtcgatggggccgtcgtcggtgctggggtgggctctggtgaaggtgtcgaggagggcggggaacccctgtcgattttgtccacccacccctg

SEQ ID NO: 378 - DNA, 1271 bp, Propionibacterium acnes
gttgagggcgtgggatcagggtgaaggcagccaaactggccgggatgaggatgacggccgcgccgacacttcggagcgaggtcatgtgacgatccttcggtagctcgacgggttgccgtagatcttttccacgttgatgccactatgtgggttgtcggcgctaaccatttggcctccaccgatgtagacggccacgtggtgggcagggcttccccagaggatgaggtcgccgactttgagctggtcacgggccacggcagtgccgactttctgctggtcggcggcggtgcggggaaggctaatgccgatacgccggtacagcgccgaggtcaggcctgagcagtcgtagccgccatcggctttgccgttgccaccccacacgtaggcgtaggagttgttgtcggcgatcgatttggcccatgccacggcttcggccaggttcttcgacacaccggtctcgttagcggccccggtggcacagttgtttgacaggttccctgtagtagtggatcccactatttgtttggccatggtttcccatttggcgtaggcatcgggcagggctgagccttgcactgcctgagctgcctgcgtcagcggcatcttctgccagtcagcgatgtcgactaaaccgggaatgtggaatccagggccgccggccgatccggggccagcgtaggtgatggtgtggcctttcaagaacgcttcggtggcgtaggcatcattgttgatctgatccagagtcccgtaccagcccggcaggatgcgctgctgaaaggggccagcgtcgccgtcaccgttaggtttcgtggaggtggggtcggctccgagatctgattcttgtttggcggtcatgatagcgatgaccgctgcctgggtaggcagtttgtcacgctggaccacagtgacgatggtggtcacgagctgcttctgtctggcggtgaggcctccggcgccgaccccgccgccggtgacagttcccatgcaggcatccccgccagcgcctccaccagagttatcgtcgagggccccagagcctactgacagcagcggcacaatgatcacggtcgctggcaagaccgccaggcccgccagcatcagaactgctgcactcaccacggcgatcacgtgagatgctttcaacgctgcccacctctcgctggtttgagggggcgacgcctgctggtacgcacaggcttggttgatccagtccgccgttgattggcaggcctgggtttgatcggcttgctgggacccggtttgggctccgg

SEQ ID NO: 379 - DNA, 1100 bp, Propionibacterium acnes
aggcgagccagacgggcaataagcgcgtagagggctcggccaaacaccttgtgcgggggcagctgccgaaacaaatgttctgacagcatctcctcggcgttaggaagagcgatgccacaagtgccaatgatgaggatgtcggcactcaggtcggcgggaggaaggtccgggtcaaagatggccgaagctagggaggccgagttctcgatgtcagcgaacacggcaatcctgtcagcgatcgcggtggcctcgggaaggtcgcactcctcggccaggtggcgggccaaacgcccacacgaggtgatctggtggtcacgcatgtaggccggtttgaggaccttggccagcgtggtcccggccacaccgatggtctccaagttaagcaaggtcagcaagaacgactgggcgacctgcccggccatctccgggggaaggatgcgcagcgggtccagcgacagcttggggtgggccgtgtcgacgatctggcgtctaaccccgtcgatagagttgacaaaggttacccactcccgctcatcggagttgtcggtggcaataatgcgcccgccccgggccgcgatggctgcgcacagccgcttctcggccatcgtcttgcccgcgcccatcttgccgatgaacgccaccgtgttgcctttctgatcctgagtgtcggcatgcaaatcgaggtaggccagcgactgcaacggggagcctgtgaccacagccaacgggatgccggtggtacggcccaaccggtactcaaccaccgggatagatgcggcgaacgcggaggcgtgagtcagctgacggtaggcgttaagcgaggaggagaaccggccaccgggccgggcagcccacagcaagtcctcctgacggcccacgggacgcacccacgtgaagtcaccgaacaccggatcattgacgaacgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctc

SEQ ID NO: 380 - DNA, 1109 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagccccgacgagacgacgcctccgcccgccacaccaacggtcaccgccccggccacgg

SEQ ID NO: 381 - DNA, 1033 bp, Propionibacterium acnes
ccacggtgacctgccacaggctcggatcagacggggagacggtagcgtcataggcggtgacggtggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatctgtgcatcgatatacctatgtatctgtctgtggtttttagaggccactcccgtcgccccgggccgctcagcgataccgcaaggctgtgtgggatcagct

SEQ ID NO: 382 - DNA, 1171 bp, Propionibacterium acnes
ccagcccgacagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggagtccttgccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctgggccgggtagtggattcgtcaccggttagctggcatgtcacggtcaccgtgacggtaatcttctgccggtctgagggggtggggacctcgtcaggtcccaccacatgagtggttttcactgatacgcatggggctgggtcaaccgcggtgaaagcggtccccgggctactccatctcgacaggtcgtcgctgccactcagcatcgcggccaagaaacccgaagaggtctgggcagccgggtcagcaggacgaatctccgaggagtccacgtcgggggctgaggccggtgcaggcatggggatctgcccaggtagacgcaaggcgatggccttgccgttggaatcgacgtggaccgggactgaccaggcctgtccgctcccggattggccgcccatggtgaccacggtgacctgccacaggctcggatcagacggggagacggtagcgtcataggcggtgacgggggtggg

SEQ ID NO: 383 - DNA, 1042 bp, Propionibacterium acnes
attatcggcgcgacaaccttactgatgacgctgttggttacgccgtagagcacatcttgtactcgtgggcgctcgacgatgctgatgatcctcgttgctggatgatgattcgtgttgacccagctggcctcctcatggagctagttatcctcatctacgacgatggctatgaactcctgatccacgccatgaaagcccgccctcagtatctgagctacttcgctatctagtgttgttgggcgagttgaactcaacttttctccgacgcaagcgccaataaaaggctgatccatccgaataccaccaaacacggctgaagtgtggaacagattcagcaagacagggtgcggtgctcgggtgcgttggggagatgaggatattcaggcttctggcgggatgtggcttgatgacgtccaggatcaccggttcggttttgaaggtgccttgcattaatgtcgacagggtcgtacgactcgaggattggatcgaccagcccgttgcgtctgaagaacttcatccaccccggtggagctccggccgcgtactggtgcaacggatcattagcatgggtagcgtgagtatgccttcgatcgtggtcagtgctgtcatcatccaagattctgacgggcggcttctcactgtccgtaaacgaggcaccgaggcattcatgctgccaggcggcaagccggagcccggcgaggactcgcgtcaggcagtagtccgggaagtgcacgaagagctcggcgtcgcattgtcttccgacgacctgcgtcgggtgggagtgttcaccacgcgagcagcgaatgaggccggccatcaggtggtggcgacgattttcacccacaccccggttgcggtgagtgagccagctgctgagatcgagcagattcgttggctcgattggagtgtcgacgccctgcctgacgacctggccccgctgctggtcgaggcagtcatcccgtggctgcggcgccgtatccggtcggtcgctgtattcacgggtgcgaaggatggaaccgaccctcattatcgtgtcgaagca

SEQ ID NO: 384 - DNA, 1057 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcgtctgagcctggcgggtgagaaccactcctgcaacgtctcacgactcaccgtgggagcgtggtaggattgatgacgataggcctcgggaaggtcaatgccgcgaaatatcggtatacccccgaggtcattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccc

SEQ ID NO: 385 - DNA, 1057 bp, Propionibacterium acnes
cccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccc

SEQ ID NO: 386 - DNA, 1052 bp, Propionibacterium acnes
cggggcggccgtagcagtccaagcggcccgccaggcactatctgctgccggggtggacgggtcggtgcaggaggacgggtcgaccatcacggtgaccacgtctcaaagtcggccgacagtgttcctgtcagcgatcggaatcagccaggtaagggggcatgggcaggcccatgctcagcttgtgggaccgggagaacgcccatgacagtgatacgtcgtatcggtgccctggtggcactgcttgtggtgatagccggcttaccggccgggctcgtggccgcaggcgccccgctagtaccctcgggcctgtcatgggcccatgtgcggcatctgttggttaccccagacatgaccgggtctgtgctggtgtggctggtcagcctcatcggctggatcgggtgggcatggttcgccctggccgtcgcagccgaagcggtgacgatgctctcagggcagcggctgcactggcacatgcccggccctcgcctagtgcgccgagtggcagccggtcttctcattgccgcgttcgcggccgcaccggcagccacaagcacggctcacgccgccgaggccacccatgtggcggtcgccgcccaggctggaccggcacacgcggcccccgcccaggacagccccgccaccacctctcaggccccggacgcctccaccactccgaaaatctggaagacctacacggtgcgggccaacgactacctgtggaagatcgccgagcactactacggtgacggcgcccaattccgtcgtatcgccgaagcctccggtatcgacccgcactcagagctgaaagtcggccagaaactggtgctaccggttcccgagaacacggccgcagttcattcggttaaagcgggggagtatctgtgggagatcgccgagcactactacggtgacggtgcccagtaccataaaatcgctgaagcttccggtatcgatgcccattccgatctagccgtgggccaaaaactcgtcatccccgggcccctccgccacgacgccacgccgccacaccactcggcgtcgacccacgcgaa

SEQ ID NO: 387 - DNA, 1057 bp, Propionibacterium acnes
cccctaggtcctgatgtgggtcgaggtccttggaatgatggaagttcctacacacccatcgccaaagacctcaacatggacaacgctaccttcaccactccctcatccgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgatcgctgatgagaggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctggcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgtcttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccc

SEQ ID NO: 388 - DNA, 1057 bp, Propionibacterium acnes; identical to SEQ ID NO: 387

SEQ ID NO: 389 - DNA, 1057 bp, Propionibacterium acnes; identical to SEQ ID NO: 387

SEQ ID NO: 390 - DNA, 1057 bp, Propionibacterium acnes; identical to SEQ ID NO: 387

SEQ ID NO: 391 - DNA, 1055 bp, Propionibacterium acnes; identical to SEQ ID NO: 149

SEQ ID NO: 392 - DNA, 1055 bp, Propionibacterium acnes; identical to SEQ ID NO: 149

SEQ ID NO: 393 - DNA, 1057 bp, Propionibacterium acnes
cccctaggtcctgatgtgggtcgaggtccttggaatgatggaagttcctacacacccatcgccaaagacctcaacatggacaacgctaccttcaccactccctcatctgtgaagagccagtttatgcacggtgttgaaagaggcgtcggtctacgacgaatgcgggttaatggtcttgcggtgtggggcgctgggcgatggcatcgagaacgcgtgagtgggtggcgatccattcggccgcgtcggggttgatgttgcgggcgacggtgtcgatcgctgttacgtagtgggcaagcctgcgaatctcagcttgttggtcagggtgagcgctgatgaggggctcttgatgggaggcgcggttacggacgtggcggatgagctccacgttttcctcgaagtcgcgtcggctacgccccgggtagtgaggcatacctccgttacgtaagtcagtgagagctttccatacggttgcttccaggcgcggggtgagcagaaagcgccagttgtccagtgacagactcgccacgatctgatcaggggtcgcatcgagcctcgcgcgccgcagtcgcttctcggccctgtcgacgttacgcgggaaaccaccgagccgatagctcggggattcccaccaacgccgtatgccagtatcggcgctcaggcgcacgtcaatgaagtttctcaggagtacctcgacatggctgatgtcttccaagaacgctttcgagatgcgggtgttccacacgtaccacgcatcgactggttcgatccggtagcggctgagcctggcgggtgagaaccactcctgcaacgtctcacgactcaccgtgggagcgtggtaggattgatgacgataggcctcgggaaggtcaatgccgcgaaatatcggtatacccccgaggccattgttttgcccaggcccctcctcgcatacttgcggggcgtcattggctgccgtcatctcgtctcttcccggtacgtggctgtccatgttcacgggcaggtacggcaatgaggttcccgcacacaaacctctaccaagcatacgctggcaagcccc

SEQ ID NO: 394 - DNA, 1057 bp, Propionibacterium acnes; identical to SEQ ID NO: 393

SEQ ID NO: 395 - DNA, 1057 bp, Propionibacterium acnes; identical to SEQ ID NO: 155

SEQ ID NO: 396 - DNA, 1057 bp, Propionibacterium acnes; identical to SEQ ID NO: 393

SEQ ID NO: 397 - DNA, 1055 bp, Propionibacterium acnes; identical to SEQ ID NO: 151

SEQ ID NO: 398 - DNA, 1003 bp, Propionibacterium acnes
ccagtcctggatcgggtgccggccgaagtcgcgtacgatagccgagtaaccaagttcgccccagcagaactggcgcatcccctctatgtcgcgccagacgtagaagggcgcgtaggagttctggggtgcgcctttgaccttttcttggatgaggtaggccttgaactccagtccatggtagccgtccatgaggtgtccagtctggatgacgcggtcgcggatgatctgcatgtcatagtcggtgggcagggtgatctgatattgcatggcgtacatcagcggttctccttggtttcgtgggagtaggtcgtgggggtgacgggttcctgccaatcgatggttgacaagtcgttggcggcttgttggtaggtaaggtggatcattggctgtttgagtgcagcgccatgccagtgtctctggccggcgtcgatccagatggattcgcccttggtcaggtgctggggtgcttgtccttcaatatggaccagggcaacgccgcccgtgacgtagaggccctgtcccttggggtgtgtgcctcagcggcaaacgtgacggcgtgggcggcacgcccggcgtcttccgtggcacgatcggccggatccatggcggcgcgcagctgctgttctgcagccaggcgtccaggtcacggcgggcagcatcgacacccagggcagcctcgacggcttcagggctacgacgctggccgggctggttgaccgcagaccactggtgccgggcgtcgtccagatcatggccggcggcgtcgatgagggcggtggtggcttcggcgcagcatcgcctgatccactccgaacgtgacaggccagctgtctcggcggcactgtcaatgcgcgccaggagagatttcatgggcgctcatctgtagcctccagataggcgttgatgtagcgcagagcctgatccgtcatgtcgatggcggctgcctcggcagacgacacaacgggctgtggatgataagaccacccaacatagacggcgaaca

SEQ ID NO: 399 - DNA, 1017 bp, Propionibacterium acnes
ctgggacccggtttgggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttcgcgccggccttcttgactgcacgatgcgctttgatagccccggcctcggcccggccaaccctactagcagtagcatcgagggctctgtggcccgtcgttgccctcaccggtgcatccttgccctggcgggtctgcttcgcgatcgccgacatgccgcctcgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccgatccggtgagcttgcgaccaccactgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacataaacgccgaccacaccaacttgcacacgtagaaccagcacatgcccgcgaacaccagcagg

SEQ ID NO: 400 - DNA, 1108 bp, Propionibacterium acnes
ccccaatgcccccacaacgatcagcacaccaacagcgatcatcaggtgggcagcactaactgatcccaacgaaccaagatcaaacaagccctgcccgggagcgtcgagcagtccgtgggcgcgaagccatgctccgagattgccaatgatcttggggaccatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggcaagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacagcagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagagtcgcgtgttcgtgaccggttcgaagacactgccgctttgccttcttgcccgtggcgcttccgagatgggttcagtgggcgatggctaggccgatgagggcgccgctgcacaggctgggtgcccaggggaggaatcgggtggtgtggtgtcggaaccggtcgatgagggcatatagggcgatcagggtgaggccggctatgaccgtggcgtggatcgtgtcgatgccggttgctgcggccggggctgcccacagtggtgtgatgcgcacgtcggagaagccgaagccgcctcgggagatgagccaggcgatcatccacgctgcgaagatgatggtggtagcgatgacagcacgtgttgccgcagtctggtccgagagggcggtaacggctacagccccgatccatccggccc

SEQ ID NO: 401 - DNA, 1004 bp, Propionibacterium acnes
tgggttcagatttcgaatgtgggaggggtttgtggatgggtatcggtgtcctcggcgagggcttggtcgagcaggcaggtggccggggtgtcggtagtctcgtccagctcgtcgatcatctcgtcgaggaagttgggggtggtggatgcggcccacacaggtgggatagccggtgcgggtcgaggcggtgtggggaggcggagtttggtttggccccagaggggtgtgtgggtcatgccggcgggagtggtggcggcgtgagtggtcacacgccaccagcccgccagccatgccagaggtgaccaggtccagtcgatgcgaccaacaacgaactgggcgagccatccggcagccagcgcgaaaatgaaaccgcggatggtcatgcccccgtcgataattttgaagcccatcatcgcggcaggaactacgccgccgacagcgagcacctgatagatcgtgtagggcccgccaggaatccttcgacctgaggaatccttaccgataatgcggggctgctggcgggcctcggtgtgccactgaatatccacgatcagctcttgcccaatccttgcatcatctgtccgaagaattggatcgcgttaccttcgataagccagtgcgccataccacacacaaacagcatggagacgatcttggccaggctcataccgtgtttgaagatgttgaacgcggcaatgcccacgactacgaccatggcgacggctcgcaccgcggactgaccttcacctgccttgatcgtcgtccattcgaagaggttctgcgattccagtggcagcaggaggaattgatcgagcatgagaggttttcctttcaggaagccgaccgggatggtcccggtactgacgggctggacggcacgggtgtgccggccaggggcagaaggcgtgacggctggtcgagggaggcaacctcccagcggcctgcacggctgacaagagtcaggccgtactggctggtccgggtagtggattcgtcgccggtgg

SEQ ID NO: 402 - DNA, 988 bp, Propionibacterium acnes
cgttgccctcaccggtgcatccttgccctggcgggtctgcttagcgatcgccgacatgccgcctcgcaatgccgaaacatgattgtgggcgtgggcgatcgccgacatgccggccgtcgcgatttttgactggccctgcggggcccctgccccagcacgaatctgctggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccgctgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgccgaccacaccaacttgcacacgtagaaccagcacatgcccgcgaacaccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatgcggccatagttgagctgctgatgaaccggcgccacgaacgagtcc

SEQ ID NO: 403 - DNA, 1053 bp, Propionibacterium acnes
cgattttgtccacccacccctgtcgattttgtccgccaagtattagacaaaccattagacagtgaattagaccctgggtcgcgtcagcgtgttagctcaccaacgcgcgcgcgcgcggcggccgagccgccgaagccaaagaaacccataccaccaacgcctgaaccagcagcccccgcttcagacagtcctgtgtcagcgcacgctgatgaggctgccgagttggcgtggcggttcgtggggtggtgtcctcagctggtaggggcaccgaagaaggtgcgtggccagctccgtcagctggtcgctgccgagatccgccggaatccgggctggctggatgcgccagcgttggaggttgttgcccagcgggtacgtgctgaaggtgcgctgggggtccagcactgcgagattgtgcgagccgagctgcacggggtgatcgccgaccagaaggccgcccccgcccgccccgacgccctgcacgcgcgggagcccaagtggtgggacgacgtgtactacgaaggaaacacaaccgtgtggtacgactctgacgaaaccagtgacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccaga

SEQ ID NO: 404 - DNA, 1009 bp, Propionibacterium acnes
gcgagccacgaccatcgccaagctgaatggagagcgagcatgagcaccacccctgccgggttcgacttcgacgctctggccgagtgggccgagagcgatgaggcgacccacaccccgcaaaccagccccgtgttccggggcaaggacgccgcgcgcgccagccgcgcattcctcggccgaggacggcccaccctcggcgcggaccacgccaccggcgagggccggtcgccccgccgtcaggtacggctcgacgcacgcaccaacgcgcgactcgacgcctacgcagccgcaaccggcaccagcgcctcccagatcatccgcgacgccctcgctgactacctgcccgcctgatcccaccccaatccactcgggcgcctgtcagtgccccctcttctgggtggtggtccggggcgtcaccgccccggaccagttgggtagtcatctcagttgaaataagcgattagtgatacgcccctcctgctttccggtgctgtcatgagcgtctgacaacagcgacacctcggggcagccgacggacagtcctctggctgccgctctgatcccatgcccacggcacgaaggtgtcggacagctcggtctcatcatgtgcccaaatagcgtcgtgggcctgtcgccaagcttctcgggagccccacacgggcacgaccgggccacaccggtgtcctggtctccagtgtcgcgacactgtcgatttcggtacgtgcaatgcggcggcggtttgacggatcgacatcccagactcccgcgcgtcccagatcgccatgtggagagtatttgcctccagtgcggccgccacacttgcacgctctcgcgcacgctcgaatgcccgcctagtgctctcaaatgtcgtcacgacgcctccccctgaaaatactcagggtgtcccacggtgggacaccctgagtatttcataccccaactcgcctcaccacacgtcgacctcgacaccgatcaagcgacccgtatcggcgacattgccgtactgctg

SEQ ID NO: 405 - DNA, 1029 bp, Propionibacterium acnes
caggtgggtttgaccgccagcgtcggattggtgctggtcgctgggctgatcaccactctcaaccgtcgttaccggacccggttcacccgtcagccccgcggcaaggccatgaccctgcccagcccggacgcccaaactgccgagatagcgctgcgcagcaccggggcgactgacactctgacgatcacctgcctcgaccaggcgctccgcgcgatcggcgcatggtgccaccactgcgggcacccgctgccacccctgctggccgcccgcgtcgatgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccgtctctggtcacactgggacgcgacgacgacggcgcccacatcctcatcgacttggaagccgcaggaaccttgcacctgatcgccgatgacgaccaggtcgacgcggccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacaccctcctcaccaccctagaagctcgcgccgacgaccagcgacacatcctcaccgaaggaaaccccctcgccgctcaccgagccgaccccgccatctccgacgggttcgacgccgaagtgatcctcctcgacaccaaactcaccgaagaccaccgcaaccgcctcgccagcctcgtcgaggctcttccccgcgtgtcagtcgccgcggtaacaaccagccccaccagcccagacgaatggtccctcaccctgacaggtgacccactagccgccgacctggctcccctcggctggcacatccacccccaaaccctctcccccgacctgtacaaccgcgtggttgaactgctcgccaac

SEQ ID NO: 406 - DNA, 1024 bp, Propionibacterium acnes
ccagcaggaccacagccaaacccgccaccgtcgacgagtaaaagaagaaccccaccaaccacgaaccatccgcaatatcgccggcgtaatccgacaacccctcatcacagtcaccaaggtcgtcgcgagcatccgagacgtcatcgtaagggccacccttgagcacctcgatgtacttgtcgtggcacttcgcatcaataatccggccatagttgagctgctgatgaaccggcgccacgaacgagtccacaatgatcgccgacagcttcggatccttcgagtctcccgtcgaggtcatgtcatcaggaatctcgacctcaccagcggtcgccgtcgcaggatcaaccgaactagtaatcatccgagacagcgccacaccgaactgctgggtgcgagccaacggagtagccaacgtcgtcgtatcgcctgcgaacttcgccaccggggccgccaagaaacccaacgccagcgccgcagcaatcgccgcacgcgcacccgtagcccacgccccagccgtacgtcccctcatcatcttgacgaccacgcccacaccggcgcacgtcgtcagcaacgccaacaccgttccaccccagctgtccgctcccagcggggccaaaaccttgtcgtggatgtcgttctgcaaccccaccagcggtccggtaatccacccgacccagctcatcgccacggtccagtccaacaaccggcacaacagggcaacgaccatcaggtacgtgttccaacacatgccaataatggaggcccacatagccttcagcggggccgtaacgccaccatcgtccatcgacatctggtactgaaacaagtgaataccgttggagtcagtcacattgaaaccgtcacccatccagcccagcccaggacccgacgccatggcaggcacactgctcagcgccaccaccagaaccagcgtggtgacgatgatacggaaccgccgctccccggccccggggcggcgtggatgacggctcacgctgtctcccggtcgtgctcgggcgggttg

SEQ ID NO: 407 - DNA, 985 bp, Propionibacterium acnes
tccctgcgaccagtgaaccgtgcccccactgcgcccacaatgatcagcacacccacggcgatcatcaggtgggcagcactaactgatcccaacgaaccaagatcaaacaagccctgcccgggagcgtcgagcagtccgtgggcgcgaagccatgctccgagattgccaatgatcttggggatcatcttgttcagtagggctatccctccgatgccgacaacgaggaagacgaggatttcttcgcctgcgttgtttcttcctgtgtttgcggtcatgctgccttctcggggtggatggccagccagctgatgaggttgtcggtgatctgccctgagatttggatcagttcgacttgcccggcctgccatgcccgcgatgtgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacaggagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgccttgtcttcttgcccgtggcgcttccgagatggtcagtgggcgatggctaggccgatgagggcgccgctgcacaggctgggcgcccagggaaggaatcgggtggtgtggtgtcggaaccggtcgattagggcatatagggcgatcagggtgaggccggctatgaccgtggcgtggatcgtgtcgatgccggttgctgcgaccggggctgcccacagtggtgtgatgcgca

SEQ ID NO: 408 - DNA, 967 bp, Propionibacterium acnes
ggtgggcgctggaccaggtttgcggggcatgcgcgcatcggtgatcttggccgccaccaggtgttccagattgtccaagtgcccggagtcagaggtcagcagaagagtagtcacctcgaccgcggtggctgaggcgatctgagctgtgcggcggtcgtgatgggtggtgtcagtgctgacagctgtggtgggagcggatgccggggccgccgaacggaccagggcaacggggccgcatgcgactccgcacagcacgagggcaaggaagcctttggtggccatcgatccggtgtggggccagggacccacgttttcctgtgcctgttttttcttggccgaccaacggcgggacttagggttagcggatgcaccttctggggtgcatgctcgtctcaatcgcatcggtcacctccttcactggatgaagggaccaaggaggtgaccgatgtgcggtcgaacccgaaaaagttcaaacttttttctgggtctgcctcaagtacgacagaaggcctgcatcatcacggcgttgtggtagcagatcttgcgtcagcgcaaatgtatgggcctcgtaggagtagctcttaggtgggtcccggtggttgcggccagggcgagggtgtcgggtatgtgtagcgctagtcccgggttcgtggtgtgagggcttttgggtgctgacatgcactacccattgctagacgctgtgctgtggcatggctggacgtctagcagacgggttgacatcacctttaggctggcagcgcccgaggccgcaggccagaggaagcggacagcctaacgattgacgtccccctctcctttccccaacctcctggagtcgatgacccggagatagatcgatgtctatgcatcggtgcatcgatatacctatgtatctgtctgtggtttttagaggccactcccgtcgccccgggccgctcagcgataccgcaaggctgtgtgggatcag

SEQ ID NO: 409 - DNA, 1055 bp, Propionibacterium acnes; identical to SEQ ID NO: 159

SEQ ID NO: 410 - DNA, 997 bp, Propionibacterium acnes
cgctcctgccagctcctcggtggtctcaaagtcaggagacgagacagtgacggtgataagagcctggatctcgacctcacgctcatcggcggccagctcggcgttgtagtcgacgagcacctgagcggaatgctcgatagacatgagggtcgaagcctgggtcatctcaccgccctcgacgttgtcgagctggtcgacggtttggcggatggcccgctgatttttctgcatcgcagcgtgacgggtccgggccactccccggatcgccacgtcgaccggcacgccagtgtcgtcgatacggcccaggaactcgtaggcaggccacgtcatcgtgcggggcaccttgcccagcgcaatgtgggactggtagacggtctcgccggtgtcggcaccgattttgaggacgcgacgattccacgcctgagccgtccgggacatgtgggagactcgcttgtcatcctcgctggccagcaggtcggaggtcgcggcctcatcgatgaccaactcccccagcgcggcacgtccaacctcatccatgagggcgattccctcgccaggggcatcatcacgcaaccgggtcgggtggcctgacaggtgctgccgaagccagatctgttcatcaacggtgaccgggcggggttggaacgctgccggcagtttcgcaccgaattccttagcctgacggagggcccactcccgtgcgacacggccaggagcggtggtcatgagtccggcggcttcggtgattttgttgagggcggcggtccaggcggtgtgggtgcgtattttctggtcttggttgagtttgatcgataggaaccacacgcgccggcctagggattcggtttcaggctggtcgagggtggcgtcgatttcgtcggcccacacggggtgttcgctcaggtcgaggccggcggccatggcgtcgacgatttctgcggggtcggtccaggtgagggctccgttgaggcagaactcgtggcgggcgaggtggcgg

SEQ ID NO: 411 - DNA, 1162 bp, Propionibacterium acnes
cccatcgtttacatcctcgactggtccctgcgaccagtgaaccgtgcccccactgcgcccacaatgatcagcacacccacggcgatcatcaggtgggcagcactaactgatcccaacggaccaagatcaaacaagccctgcccgggagcgtcgagcagtccgtgggcgcgaagccatgctccgagatgaccgatgattttaggggccatcttcttcagcagggctatccctccgataccaacaacgatgaaggcgaggatttcttcgcatccgttgtttccttctccggtggggccgttcatgctgccttctcggggtggacggccagccagccgatgaggttgtcggcgatctgccctgagatttggatcagttcgacttgcccggcctgccatgcccgcgatgcgccggccagcaatgatgctgggacccctactgcgcggccacgggatgcaacctcagccaaggcggcgcgtaactcctcgacggtgctttcgatgtaccaactgccgtcagtactagtctcagcggcatcggtggtagcgataagagcatcggtgaggtcgtcgacggcgcggtccagatcagcgatgtccggtagggctacagcagtcatggtgtgtcttccttctagggtgccttcactggtgaagggtccctagccccggccgatgtgcggtgctgtgggaaaaatgcttcccattggtccgtcttagttaggaaacttggcctaagtgctgtcgagggtcgcgtgttcgtgaccggttcgaagacactgccgctttgccttcttgtcagtggcgtttccgagatggggtcagtgggcgatggctaggccgatgagggcgccgctgcacaggctgggtgcccaggggaggaatcgggtggtgtggtgtcggaaccggtcgattagggcatatagggcgatcagggtgaggccggctatgaccgtggcgtggatcgtgtcgatgccggttgctgcgaccggggctgcccacagtggtgtgatgcgcacgtcggagaagccgaagccgcctcgggagatgagccaggcgatcatccacgctgcgaagatgatggtggtagcgatgacagcacgtgttgccgcagtctggtccgagagggcggtaacggctacagccccgatccatccggcccatcc

SEQ ID NO: 412 - DNA, 933 bp, Propionibacterium acnes
ccccgactaccagacccgccgtcgtgaacgcagggaaaccctgcgagccacactcagggccgcccagcagcatgtcaggacacactgatacccgctcatacacacaccatgaaacacgacaagccacctgacagtatcagctgcaagacgcatgacaacatagaaggacatgatgaaatacacatagacacaaccccgcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaac

SEQ ID NO: 413 - DNA, 928 bp, Propionibacterium acnes
gacgacgacgaggcgtggaaccggtcgcaggtatgtcatgttgctgagcgtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggccacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccatcaggcccgagacaccctcacccacgacaacccccatgaacgccgcct

SEQ ID NO: 414 - DNA, 957 bp, Propionibacterium acnes
ggcagggtcgtcgggttcttcggttacctcgggtggggtcgatctggctgtctcggtgtcgtcggccaggtcggctcccaggatgcgttcccattcggggctggttttcttgcccgctgaggccatcgtctcgtcgatctgttcgtcagtgggccacacaaatttctttttggtccaggtcgtggtgtcgggtcgcagctgatccagcagttccaggtcttgcggggagtgggccttgcgggggtcgggggtgtagaagaattggacttccttgggggctgattcgccggataggtaggtgcctcggccgcgtttgccgaacgggatgcccacgccgacgtgttcggagccgaacatcatgcgggctccgtcagcggacaggggtccggtggcggcacgcccggagaagttgtctcggatttcgccgcccaggaactcggcgtcggggcgttgggtccccagatcgacgtggatacggcaggcggctgccatgcgcagcagggagccgatccagccgaaaacggggcattctccgggcatcccagagaccttgatcgttgaccaccagtttttcgcgttgccgtagaactggcggtactcgtcgatgaggaccagcacgcgggtgaagtcggtctcgcgggccccttcttcttcgatgcggcggtagcggtcctccatgagagaccacagccagtggatgagggcgacctggtcggggacggtagtggcgaccatctcgatgttgggccactcccgcaggcccaggtactcgatgcgtttagggtcgatgacgaagacgcgccagttgcggcgggcaccctcgacggcgtcgccgatcatggacaccgtttttccggtacgggtgcggccggccttgagctggtgggccatgacaccggagatgtcccagaaacaggtgttgccgtcctcgtcgacggcctgggggattttctccca

SEQ ID NO: 415 - DNA, 947 bp, Propionibacterium acnes
ggctccggagtcttaggctccggcttcacatgcctaggcacttcggctgcggtgggaggagtcagcacgtggcgtaccggcttggtgaccttctgggcacccgaaacaaccggcttagacaccaccttggcacctttgaccaccggtgcggctgccttagcgccggccttcttgactgcacgatgcgctttgatagccccggcctcggcccggccaaccctactagcagtagcatcgagggctctgtggcccgtcgttgccctcaccggtgcatccttgccctggcgggtctgcttagcgatcgccgacataccgccccgcaatgccgaaacatgattgtgggcgtgggcgatcgccgacatgccggccgtcgcgatttttgactggccctgcggggcccctgccccagcacgaatctgccggtaagccgccgacgtgccacgagcacccgccgccattcgcgccaccttcgcagccctagtcactcccgtcgacacgccacccgtggctaccgcagcagcacccgagaccacagtcgaggccatccgccttcgacccaatccggtgagcttgcgaccaccactgcgcaccatccggcgagcaccccgcccagcccactggccgatcaccgagcccctttcggaacgcttgctgcgcatccaatcgttgatcttgtccctcagccccttctcgcccttgtgacgacgccacatggacatcaagaacccgataatccccacgagctcgagcatgttgacaaccatgaccttgatggcgacatcaccgtcagaggcgaaaaccgacttgatgatgagcatgaccacacccaacatcaccatcgacccgacaatgccgatcatcgagtacaagatcgaacacagatcccggatgagcggatctgtgcggccagggatagcccgcaacacgttgagcatcgacatgaacgc

SEQ ID NO: 416 - DNA, 926 bp, Propionibacterium acnes
ccctgcgagccacactcagggccgcccagcagcatgtcaggacacactgatacccgctcatacacacaccatgaaacacgacaagccacctgacagtatcagctgcaagacgcatgacaacatagaaggatatgatgaaatacacatagacacaacccagcacagcagtttcgcaacaaatcatgatagtctcatggcagtatcgcttgatacacacatagcatcactcccacataggcagttatgctgatatactcctactaggttatccgtccaacatgctgagtgggttcctgtacagcatgaaaggagcatggcatgatatgggccgttctcaactgcaagggtggtgtcggcaagacgaccagtgccctcctgctggcggcagccgccgccaagcagggccacaccaccctggtggccgacgctgacccccagggcaccgcatcccagtggtcagccctggcaaccaaaaacgacgaacccctgcccttcccggtgcaagcggtcaacatcgccaccatggaggcactgcccaccaccaccgacgcccatgatctcatcctcgttgacacacccccctcggcaggcgatctgatgttccaggcatgccgcatcgccgacctcatcatcatccccaccgccacctccggacccgacatctcccgaacatgggtcaccatggacgccacacaaggcacaccacgcgcgatcctcctcacccaaaccgaacacaaccgtgtcgtctaccgccaagctcgcactgccctcgccgccgacgacaccgtcgttctcctggaccacgacatcccccgccgtgaatccatccgcacagcatggggcaccaaccccccagacgacgtcatcacctactacctgcccgtcctcaacgaactcatggaggccctgtcatgaccaccaagaaa

SEQ ID NO: 417 - DNA, 930 bp, Propionibacterium acnes
ccggtttcggctgttgcttcggtcttcatggtagctgatagcccgcgtcgttggaagtgcgacgacgccgatcctcatcggtatcgcaccctgttccagggtcgagaatgtgaaggattaacaaccatgacaagtcatgagacgccctccctgagggcgtcatgaccgctttaattcaagctctgccgacagctgaactgtctgctggacctggtgctagcagtccagctagaccctctgctgagggcttcatcaagattcatcacgaccttattagtgcgggcgtgtcgggtaacgcgatggcgttgttcgtcgcgttacgtaaccagcccggctgtgatcagtggacccgtcactcgtacctgcggctagcccaatggtgcggctgggatgggctgtcggaggcggcgggctgtaagcgggtgcagcgggccgctgctgagctcgctagcggtggttggctggaatcgcgggtcggccatgatcgtcgcaccgctaagacgctggtgtggcatcggttgaccagccccgacaccgaccgctgggagcaattgccgcggattgtgtgggcgaggatctgccagatcgccggggagacgtcgggagagtgggtgaggcattggctggtgtggcggatgctggccggtcgtactggtgtggctcaggcccctatgtccatcgtggctcggttcctgggctgttcttcgcgccaggtctctcatatccgtggggctctcgttgatgccggtctgctcggctgtgacgaggtctcgggggcggcgagccgggtgtggttcccctcgatggccgaggagtgtgcagcggatcgtgaggtggttgatggggccgtcgtcgatgctggggtgggctctggtgaaggtgtcgaggagggcggggaacccctgtcgattttgtccacccacccctgtc

SEQ ID NO: 418 - DNA, 909 bp, Propionibacterium acnes
aaccaggaacgaggacgataggccgatgctggtcaggtcgcgatgttgaagtcatggagacatatttgcacagtgcgcggacaagggagtggcactatttctggcatgaatttagatctgggtgtccggtgaggcgatcagaacgcctccatgtactgtccgagtgtctacgatgcagcggacacagtcgagcagctggctcacaagtttccaggtgtccttctgcccctatgagggaagtcggctgctctcgcaacctttgagggctgctctggggtcggaaccagttacagatcgttcaagttccgggaactaccgccggtcacgctgattgattcccgggcgatctcgcttctgacgacagtggtcggtgaccgagaggcgtcctactctgaccccgctgctgcggtgagtaaatcacgggcgtcccggatccggccacccgtccaagtgccagccagcttgatcggctaggcatcgtcaaggagcgacgatgaggtgatgatgcgatgtgagcgcaccgcgaagtgaggtataaagaagccttcccgggcgcatgcgtcgcccaggaaggccaggttggcccctggacggctgaatggttgggcggatcaggctgtagcggagacgtgcagtacctcgtaggcgatggcgttggttgggctctggtctgcatcgtggctactgagttcgacgaggatgacggtccaggtggtgatgtcgacggcggtgacgcgggcgatggtggaatcagtggatgctgcaaggaagtcggcggttatgtcttcgatgcagtgggacggagcagtgctggtgggcaggggcacggtcttgacggtcaggcttcgggcagcagagtaatcggcggttccgttaacaagctggtggacggtccagtcctggatcggg

SEQ ID NO: 419 - DNA, 939 bp, Propionibacterium acnes
gtgacgacatggctggcgggattgctaccaacctgctggcctcccacgctgatgatccgatggcctggctgactcgccgtcaaaccatgctgatggctcgtttcccccacgcccagaacgaggtcatcgcgatgtgccacatcgtgcgcaccgccctggaggccgacatggccgccggaacccggtgggaggactgatgagggtctcccggcgcgccctcatggccgtggcccgtgccgacgctgccgcagcagaccatgccaccggccgatgggtggtcacagccaacgccaccgtcgcccggctgaccggactgtgcgaacgcaccgtccaatacgcccgcgccaccctggtccacctgggcctgtgccgcgtcgtggccaccggccgctacctcaccgccgacgagcggcgcacggctgctcgcacccatggcggccgccagatgcgcgccgcctccacccgcgtcctcaccatgtcctgcgcaatcgtttgcgccctaccccgaaggggtcaccactacaggaaagttaagttcctagatggtcaccaacgcacgcgcaggcgcgtgcgaaggccagcaacaccagagaagaaacccctgtggctgcaaaaactcgcagccctcctcgaccagcacctgccctggctggtgagaaaccatcacatcggccgactgtgccacgccctcaccgccctgggcatcgacgaacactggcaacccgcagacctcgacgccctcctcgacgccatgaaccgcaggaaccgtcgcctcggcctcgacgtgccatgcgccgacgaccagcacaaccccttgggactgttcatccaccaggcccgagacaccctcacccacgacaacccccatgaacgccgcctggcccgcgaacaccaccgcgcccaactcatcgacgaccaactccgccgccgcgcagaaac

SEQ ID NO: 420 - DNA, 967 bp, Propionibacterium acnes
gacgccggccaccccaactactccgacccacacggtgaccccagctccggcctctgccggccactcgaccagcgacgagcacccaatccatacggataccgccacagcggacaaggccagcaacgaggacgccctgtccccaatccaggtgggcttgaccgccagcgtcggactggtgctggtcgccggactgatcaccaccctcaaccgccgctaccggacccggttcacccgccagccccgcggcaaggccatgaccctgcccagcccggacgcccaaactgccgagatagcgctgcgcagcaccagagcagccgagactctgacgatcacctgcctcgaccaggcgctccgcgcgatcggcgcatggtgccaccactgcgggcacccgctgccacccctgctggccgcccgcgtcgacgacgaccggatcgacctgctgctatcccaggcggcccccgaccatcccgaggcggtggagctggccgccgacggatcggtgtggaccctcaccgccgaccggatcgacgacctgctagcccacaccgatgacaaccaagcggctccgtggccagctctagtcacactgggacgcgacgacgacggcgcccacatcctcatcgacttggaagccgccggaaccttgcacctgatcgccgacgacgaccaggtcgacgcagccctcgccgcgatcgccgtggaactggccacctgcgactggtccgacgaagtcaacgtcaccctcgtcggccaggtgtgcccgggcctagaagacgcactagagtctccgaccctgacccgcgccaccgacgtggacgccctcctcaccaccctggaagctcgcgccgacgaccagcgacacatcctcaccgaaggaagccccctcgccgctcaccgagccgaccccgccatctccgacgggttcgacgccgaagtgatcctcctcgacaccgaactcaccgaagac

SEQ ID NO: 421 - DNA, 882 bp, Propionibacterium acnes
ctctacggggccatcatcgccgcctccaccctggacccccacctcagcatcgacgccctagcccgcctctaccagctccccctcgacctcgtgacccaagccctcaccgtctaagcgtcgatgagcgggggagaggtagcgcactatcggctaaggaaccccacaaacaccaaacccttgtcactgggaagggtttggtgttatgctggtctcacaactcaacagaggaggtgagacatgggaaatgagtaccagaagtcgctcaaagtcctgttcaagaaactggaatctgagcaaggagcccgcatcgagacccggcgcaaaggatggatgatctacccgccggatacgtcacgatcagcggtcatgatccacaagactccatcagatcgcagagcatgggccaacatgctttccgaactgagacgctcaggattcaccgtctaactcagtgaagggggctggagctccagccccctttcaaccacctcccccggacaccacacaagaaaaggagaacatgatgtggcacgttcggttgtcgcttcgcgcaatcagcgaggacatgctgttcgacgccctggacaccctcgaccccttatccccggtggccacactgggccccgatgagcacaccggatcattggcggtgttcgtcgaggctgactcactgacagacgccatcgagactgcccgcacagccatcaccaacgcatgcaacaccgccaccataaccggcgtagaagcccgccccgaagacgaatgcttcgcagacgttgaccggcccctgttcccgccagtggtcggatacaccgaaatcgctgaaaccgcaggactctcacgtcagcgcatccgccagctcgcaggcaccgccgggttccc

SEQ ID NO: 422 - DNA, 880 bp, Propionibacterium acnes
agttggtatgcccgcgataagaagggcaccgtcaagatgatcgcattcaactcaacggaggtccccacatgcgacgtcaagtaatcaccgcggccgtactgggcctggccctggccaccacctccctgcccgccctcgcaggcggcggcgacttgaacggcagtgtggacacggatggccctggttacgatgtgcgtactgaggtggattaccatcacaccaccggtggtgcgggtgggggtgccacgacagggggccatcatgggggcaaaacccacggtgatggtgaaggtgaggctattgatgggcgttctcgcgccgatgccgaagccgaactagacgaagccgaccgtaaccaggacttgacttgtgatgtcttgctcccaccggcgccgaataccccagccggccaggaatgggcgaaagaatgcaatcccccagcgaaaaaggggcagaaggccaccccgaagcccgatccggtgttagtgggccgtcacgcggccttgcagctcacccttcccggcgcggcccctcgtatcgatccgtcccccgaccttaaccggtggcactcggcagcagtgggccaggctttgtggttgtcggttgatgaccccaccgccactacgcagaaatcgatcacgtttatgggccaggttgtctcgttgagcgccaaacgtaacggtttgtcgtttgatatgggtgatggtcatgtcgtgcactgtgatgccacgacgacatggacggagtcggtggaaccggggaccccctcacccacgtgcggttacacctaccaacaggcagccccggccgggggctataaggtcaccgcaatcacgtcgtgggatgtgacctggtcggtactaggacacacgggcacagt

SEQ ID NO: 423 - DNA, 1061 bp, Propionibacterium acnes
gaaggttccctagacccggccgatgtgcggttctgtgggaaaaatgcttcccattggtccgtcttagttaggaaacttggcctaagtgctgtcgagggtcgcgtgttcgtgaccggttcgaagacactgccgccttgccttcttgcccgtggcgtttccgagatggggtcagtgggcgatggctaggccgatgagggcgccgctgcacaggctgggtgcccaggggaggaatcgggtggtgtggtgtcggcagcggtcgatgagggcatatagggcgatcagagtcagcccggctatgacagtgacctggatcgtgtcgatgccggttgctgcggccggggctgcccacagtggtgtgatgcgcacgtcggagaagccgaagccgcctcgggagatgagccaggcgatcatccacgctgcgaagatgatggcggtagcgatgacagcacgtatcgccgcagtatggtccgagagggcggtaacgactacagccccgatccatccggcccatccggtccacgctaggactgccggtatccatgtggtgatggcgtcaatgacggcaacccatgccccgatggtggctagcagggcccacgtcggccacgtgggtgctggggcccacattgtggcggcgatcatggtgaccgcagccgcggcacagaccgcgatcaagcttcggagactgtaggtgtcgcggtagacgatcttgtcggggctggcggtagctggttcgggcaggacgcgggtgagggcaggccatcctgcgaccgcaatagccgcgacggcgaccacccacacgatctgttgcatgggtctcatcatggcccatcatcgatgagtatgggtggccgacatggggtcactcgtagaggggatcgaggggtgtgcgggcgagcatggcttcctgtgtgccgagcatgagggtgccagaatcctcgccagccgattcccagtcgacgatgacctggtcgccgtcaacgctggattcggcgatggtcacccattgcccgtccatgtcgatgagcatcccggcggccagctctgtggcggcaaccggg

SEQ ID NO: 424 - DNA, 26620 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggggaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacagattcctcgtcctcgacggtgcgcaccgggcccaagcccaccagtactgccatcgatctgagatccgagcccgcctccacaacctccccctcagcgcggaaataccaggctggagccactccataccccgcgatgcagcagcgaaactggctcacctactcctccccgtggacgctctcggtcaggcggaaatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcgcccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctggccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacgcctgcgcaggacgctttcgcccaagctgctcaagacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggaccgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagccgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatactgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcggaacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccgcacacccccagtaccgagaaagaaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccgtcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgattcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggagagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggaatggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctccactgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcgaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggcccggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaaaatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccgatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattagtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcccccatccaaatcttcgcgcgctcatcagccaggccgcagtcgaggacatgatgggaaatccgactagtttaccacatgcctggaacctcgaggacatgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctgtgcggaacactgatgtggccttgccgaacggcctgttctccggttgggagggaatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacgccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccgccgactcctgacgcacggcctcctcgaccgcccggctgagcagggacccggccctgaccatcgacgtctccgggtccggctcgagatcggacaacgcgatgatccggtcgaacgcggaccgtttctcctcgggcaggtcacagcgtccgcacaccgcccagacgggcaccccggcgtcccgggcgatcttgcggatggtgtcgggaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 425 - DNA, 26620 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggggaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacagattcctcgtcctcgacggtgcgcaccgggcccaagcccaccagtactgccatcgatctgagatccgagcccgcctccacaacctccccctcagcgcggaaataccaggctggagccactccataccccgcgatgcagcagcgaaactggctcacctactcctccccgtggacgctctcggtcaggcggaaatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcgcccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctggccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacgcctgcgcaggacgctttcgcccaagctgctcaagacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagccgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatactgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcggaacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccgcacacccccagtaccgagaaagaaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccgtcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgattcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggagagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggaatggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctccactgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcgaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggcccggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaaaatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccgatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattagtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcccccatccaaatcttcgcgcgctcatcagccaggccgcagtcgaggacatgatgggaaatccgactggtttaccacatgcctggaacctcgaggacatgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctatgcggaacactgatgtggccttgccgaacggcctgttctccggttgggagggaatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacaccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccgccgactcctgacgcacggcctcctcgaccgcccggctgagcagggacccggccctgaccatcgacgtctccgggtccggctcgagatcggacaacgcgatgatccggtcgaacgcggaccgtttctcctcgggcaggtcacagcgtccgcacaccgcccagacgggcaccccggcgtcccgggcgatcttgcggatggtgtcgggaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 426 - DNA, 26620 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggggaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacagattcctcgtcctcgacggtgcgcaccgggcccaagcccaccagtactgccatcgatctgagatccgagcccgcctccacaacctccccctcagcgcggaaataccaggctggagccactccataccccgcgatgcagcagcgaaactggctcacctactcctccccgtggacgctctcggtcaggcggaaatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcgcccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctggccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacgcctgcgcaggacgctttcgcccaagctgctcaagacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagccgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggcctccccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatactgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagattatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcggaacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccgcacacccccagtaccgagaaagaaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccgtcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgattcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggagagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggaatggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctccactgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcgaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggcccggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaaaatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccgatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattagtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcaggaatcgccgctccctggttccagtcggacgacacgattcccgatccggcgacgactgacgatctccacactcttctcgtggatccgacttgcggccccgcgcttgtcccccatccaaatcttcgcgcgctcatcagccaggccgcagtcgaggacatgatgggaaatccgactggtttaccacatgcctggaacctcgaggacatgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctgtgcggaacactgatgtggccttgccgaacggcctgttctccggttgggagggaatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacgccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccgccgactcctgacgcacggcctcctcgaccgcccggctgagcagggacccggccctgaccatcgacgtctccgggtccggctcgagatcggacaacgcgatgatccggtcgaacgcggaccgtttctcctcgggcaggtcacagcgtccgcacaccgcccagacgggcaccccggcgtcccgggcgatcttgcggatggtgtcgggaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 427 - DNA, 26620 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggggaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacagattcctcgtcctcgacggtgcgcaccgggcccaagcccaccagtactgccatcgatctgagatccgagcccgcctccacaacctccccctcagcgcggaaataccaggctggagccactccataccccgcgatgcagcagcgaaactggctcacctactcctccccgtggacgctctcggtcaggcggaaatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcgcccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctggccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacgcctgcgcaggacgctttcgcccaagctgctcaagacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagccgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacagggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatactgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcggaacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagacccttactatcgatggcggaatgatcaacggctgaccccaggacccgcacacccccagtaccgagaaagaaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccgtcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcatacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgattcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggagagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggaatggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtggggctggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctccactgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcgaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggcccggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaaaatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccgatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattagtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcccccatccaaatcttcgcgcgctcatcagccaggccgcagtcgaggacatgatgggaaatccgactggtttaccacatgcctggaacctcgaggacatgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctgtgcggaacactgatgtggccttgccgaacggcctgttctccggttgggagggaatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacgccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccgccgactcctgacgcacggcctcctcgaccgcccggctgagcagggacccggccctgaccatcgacgtctccgggtccggctcgaggtcggacaacgcgatgatccggtcgaacgcggaccgtttctcctcgggcaggtcacagcgtccgcacaccgcccagacgggcaccccggcgtcccgggcgatcttgcggatggtgtcgggaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 428 - DNA, 26620 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggggaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacagattcctcgtcctcgacggtgcgcaccgggcccaagcccaccagtactgccatcgatctgagatccgagcccgcctccacaacctccccctcagcgcggaaataccaggctggagccactccataccccgcgatgcagcagcgaaactggctcacctactcctccccgtggacgctctcggtcaggcggaaatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcgcccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctggccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacgcctgcgcaggacgctttcgcccaagctgctcaagacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagccgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatactgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcggaacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccgcacacccccagtaccgagaaagaaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccgtcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgccatccccgacccacccatcacatggagtgagggtgacatcacggttcagctcgatccctgcggccgcgcctccctgatccactcgaccctggtggaccgaagaatccacttggacgagtctggctcggcaagtctcaccatgaccgtgtttggtgattcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggagagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggaatggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctccactgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcgaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggcccggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaaaatgtcaccaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccgatcaaatgctggcggcgtgtatcaggcaacatggagagacggcacatcggtagtcgtcaaggaggcccggcacctgtccggacttgatgcggcgggggtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattagtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcccccatccaaatcttcgcgcgctcatcagccaggccgcagtcgaggacatgatgggaaatccgactggtttaccacatgcctggaacctcgaggacatgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctatgcggaacactgatgtggccttgccgaacggcctgttctccggttgggagggaatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacaccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccgccgactcctgacgcacggcctcctcgaccgcccggctgagcagggacccggccctgaccatcgacgtctccgggtccggctcgagatcggacaacgcgatgatccggtcgaacgcggaccgtttctcctcgggcaggtcacagcgtccgcacaccgcccagacgggcaccccggcgtcccgggcgatcttgcggatggtgtcgggaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 429 - DNA, 26620 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggggaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacagattcctcgtcctcgacggtgcgcaccgggcccaagcccaccagtactgccatcgatctgagatccgagcccgcctccacaacctccccctcagcgcggaaataccaggctggagccactccataccccgcgatgcagcagcgaaactggctcacctactcctccccgtggacgctctcggtcaggcggaaatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcgcccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctggccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacgcctgcgcaggacgctttcgcccaagctgctcaagacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagccgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccccgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgcccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatactgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcggaacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccgcacacccccagtaccgagaaagaaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccgtcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgattcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggagagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggaatggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctccactgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaaaacgaaaaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcgaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggcccggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaaaatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccgatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattagtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcccccatccaaatcttcgcgcgctcatcagccaggccgcagtcgaggacatgatgggaaatccgactggtttaccacatgcctggaacctcgaggacatgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctgtgcggaacactgatgtggccttgccgaacggcctgttctccggttgggagggaatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacaccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccgccgactcctgacgcacggcctcctcgaccgcccggctgagcagggacccggccctgaccatcgacgtctccgggtccggctcgagatcggacaacgcgatgatccggtcgaacgcggaccgtttctcctcgggcaggtcacagcgtccgcacaccgcccagacgggcaccccggcgtcccgggcgatcttgcggatggtgtcgggaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 430 - DNA, 26620 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggagaggtcacagacaatgataacagaaagcatccccacgcggctgctcgtgtggcacgagcagaccgatccgaccaagctcctcaggatcaccgacgcgatcaggaggggggatccccttccccccatcgaggccatggcgatcggccacagattcctcgtcctcgacggtgcgcaccgggcccaagcccaccagtactgccatcgatctgagatccgagcccgcctccacaacctccccctcagcgcggaagtaccaggctggagccactccataccccgcgatgcagcagcgaaactggctcacctactcctccccgtggacgctctcggtcaggcggaaatcgtcctgcacggggtgcgccgtcaggtggggaccgcttcacaacgaccgcgcgacatctttctcgcctgccaccggatcgcgcgagttgcctacgcgcatggaatcagacctctcggcccggagctctccaacgctccgacgatcgacgccgccaccatgacctggcgcccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctggccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacgcctgcgcaggacgctttcgcccaagctgctcaggacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagccgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgaatcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatgctgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcggaacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccgcacacccccagtaccgagaaaggaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaactagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccgtcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgattcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggagagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggagtggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctccactgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcgaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggcccggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacggtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaagatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccgatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattggtaggcgacctcatcggctatcgatgaccgatttttcacgctggtgccgataggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcctccatccaaatcttcgcgcgctcatcagccaggccgcagtcgaggacatgatgggaaatccgactggtttaccacatgcctggaacctcgaggacatgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctgtgcggaacactgatgtggccttgccgaacggcctgttctccggttgggagggaatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacgggatcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacgccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccgccgactcctgacgcacggcctcctcgaccgcccggctgagcagggacccggccctgaccatcgacgtctccgggtccggctcgaggtcggacaacgcgatgatccggtcgaacgcggaccgtttctcctcgggcaggtcacagcgtccgcacaccgcccagacgggcaccccggcgtcccgggcgatcttgcggatggtgtcgggaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 431 - DNA, 26620 bp, Propionibacterium acnes; identical to SEQ ID NO: 430

SEQ ID NO: 432 - DNA, 26636 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggagaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacaaattcctcgtcctcgacggtgcgcaccgggcccaagcccaccagtactgccatcgatctgagatccgagcccgcctccacaacctccccctcagcgcggaagtaccaggctggagccactccataccccgcgatgcagcagcgaaactggctcacctactcctccccgtggacgctctcggtcaggcggaacatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcccccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctgaccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacacctgcgcaggacgctttcgcccaagctgctcaggacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagctgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatgctgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcgggacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccggacacccccagtaccgagaaaggaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccatcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgactcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggggagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggagtggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctcccctgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcaaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggccaggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaagatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccaatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattggtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcctccatccaaatcttcgcgcgctcatcagccaggccgcagtcgaggacatgatgggaaatccgactggtttaccacatgcctggaacctcgaggacgtgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctgtgcggaacactgatgtggccttgccgaacggcctgttctccggttgggaggggatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacgccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccaccgcccctcagcccgccgactcctgacgcacggcctcctcgaccgcccggctgagcagggacccggccctgaccatcgacgtctccgggtccggctcgaggtcggacaacgcgatgatccggtcgaacgcggaccgtttctcctcgggcaggtcacagcgtccgcacaccgcccagacgggcaccccggcgtcccgggcgatcttgcggatggtgtcgagaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 433 - DNA, 26636 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcacggagaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacaaattcctcgtcctcgacggtgcgcaccgggcccaagcccaccagtactgccatcgatctgagatccgagcccgcctccacaacctccccctcagcgcggaagtaccaggctggagccactccataccccgcgatgcagcagcgaaactggctcacctactcctccccgtggacgctctcggtcaggcggaacatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcccccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctgaccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacacctgcgcaggacgctttcgcccaagctgctcaggacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagctgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatgctgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcgggacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccggacacccccagtaccgagaaaggaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccatcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgactcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggggagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggagtggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctcccctgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcaaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggccaggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaagatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggcccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccaatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattggtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcctccatccaaatcttcgcgcgctcatcagccaggccgcagtcgaggacatgatgggaaatccgactggtttaccacatgcctggaacctcgaggacgtgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatataccctctgggaacaactcgccgtggctgtgcggaacactgatgtggccttgccgaacggcctgttctccggttgggaggggatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacgccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcaaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccaccgcccctcagcccgccgactcctgacgcacggcctcctcgaccgcccggctgagcagggacccggccctgaccatcgacgtctccgggtccggctcgaggtcggacaacgcgatgatccggtcgaacgcggaccgtttctcctcgggcaggtcacagcgtccgcacaccgcccagacgggcaccccggcgtcccgggcgatcttgcggatggtgtcgagaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 434 - DNA, 26636 bp, Propionibacterium acnes
ccttgtggacaccacgtcatccacatgacttgtgtcacatgattcccggaccatcatcaagcagatgctcacccaactgtaatgatttctgttctgaatctggacatgctctgacctgcattcaatgatcaattccgtgcgatattccacaacgcgcggagaggtcgcagacaatgacaacagaaagcatccccacgcggctgctcgtgtggcacgagcagaccgatccgaccaagctcctcaggatcaccgacgcgatcaggaggggggatccccttccccccatcgaggccatggcgatcggccacaaattcctcgtcctcgacggtgcgcaccgggcccaagcccaccagtactgccatcgatctgagatccgagcccgcctccacaacctccccctcagcgcggaagtaccaggctggagccactccataccccgcgatgcagcagcgaaactggctcacctactcctccccgtggacgctctcggtcaggcggaacatcgtcctgcacggggtgcgccgtcaggtggggaccgcttcacaacgaccgcgcgacatctttctcgcctgccaccggatcgcgcgagttgcctacgcgcatggaatcagacctctcggcccggagttctccaacgctccgacgatcgacgccgccaccatgacctggcccccgccgaacgtgggcacgttgtgggccatcgccagcagtctcggacccctgcccgcaactgtgacccggttcgccccgatcctccggcacgacgccatcggggattccgcgatgacacccgtcacctccgccgcgtgacgacccgcgccaattccgccccaccactggatgaggggcagccgcgtggacgatgctcctgttcaggcagggactccatacgagaccaataggaaaatcatgatcaaaaacacaagccctctgaccgtgaaaaatgtctcgaaaacattccgtggctccagcggagaagccatcaaggccgtgcaagacgtgtcattcaccgttgagcgtggtgaggttgtggcattcctcggcccgaacggcgccgggaagtccaccaccatcgacatggctctcggcctcacccgccccgacagcggccagatcgaggtcttcggtactgacccgctcagcgcggcccggtcgggacgctgcaccgcgatgacacagaccggcgggttgctgcccgacctcacgattgggcagaccatggagatcatctcctcgctctatcgtggctcccacatgaatgcctgcatggagcgagcaaggatcacgcatctggccgatcggcaggtgtcgatgtgctcgggaggcgagcgccaacgacttcgcttcgcactggctctgctgcccgatcctgacttcctcatcctcgacgagcccactgcggggatggatgtggaggcgcgccgggacttctgggcagagatccacgaggacacgcgtcgtggtcggacaattctgttcgcaacgcactacctcgacgaggtggacgagttcgccgatcgggtcatcctcatcaaggagggccgcgtcatcgccgacgacacctccgacgcgatccgcaccatgtcggggggttgcaccgttacggcgaccattcccgacttctccctggcacgactgaatctgccgggcacccaactcatcaagcagggcggcgcacgcgttgatctgcaccatcccgattccgatgccctcgcagcgcgagtcatccagctcggcggcaccgacctgcgcgtggtcccccgcagcctcgacgacgccttcctcgctctcacctcaaccaccaaggagtcctgacatgaccgcccaagcgcttcccgcagtcgccactcccaaggcccgccaccgatccgccatctcgctgaagtacttgtggtgcgagatgcgtcgccccttccggcgttcgacgatgctgttcaacctcgccctccccgcagttctgtacctggccctgttccgcaccgtccacaccgccgagctgccggacgggaacttcgcgatgtggatgatgatcggcatcgctgtctacggagcggccactgcgagcaccagctacgcagcctccatctccgtcgacgaggccaacgggtggacccgcaccatccgcctgacgccgttgtcgtcggtcgggtacgtgctggtgaaggtcctctgcgccatggccatcgccctggccccgaccctgctcatcggtctcatcgggctgttgaccggagctcacggcacgctgcgggtctgggtaatcggactgggggcggcttggctcagctcagcaatcttctccgccttcggcctggctctcggactgtccctgcgtcccgaggtcgtcatgcacgtccccggcctggtcatcaccggtctggcgttcctgggcaacgtcttcgtccccctcagcgggacgatgctcaccattggccgctggagccccgcctacggcatcaccgcgctggctcgttacccgctcaccaacggcatcgacatcgggggcggccacgactccctgacggctgccctcatcggcaccttctgctggttcgccggattcgtgttctgggcctcccgtcgatttaccaagagcacgggtcgtcagtgacagattcggccgatctccggaaggagcagtgttatgaccaagcccctcattgcagtggtcaccgcgggccaaggagcgcagaagcctcgcctgctcacgccatggctcaaggtccccggcgtcacggagaagcttgctgcatggtccgctcaggccgatgtggacctcgtcgagctcggtaccagggcgaatgcagaaaccttggcagcgaccgagaatgcgcagccactactggtctgtctcggagtcctcgtctcggatctcctgaccgaccagaacattgtgctcgcaggacactccgtgggcgagctgacagcagcgtgtctcgccggggtagttgatcccgggacggccgtcactcttgcacgacggcgtggactggccatggcgcgggcctgcgctctccacccgaccaccatggcggccatcattggtgacaatccggatgacgtcctccggcggctctcggaactgggactcacggctgccaacatcaacggaggcggacagattgttgcggccggctccaccgacgcgatcgcggaactggtggcgacccctcccaacgggaccgcagtcaagccgttgcgagttgctggcgcctttcacaccaagtacatgacacctgcgcaggacgctttcgcccaagctgctcaggacgtcaccttctccgacccgcagcacccgatcatctccaacctcgacgggcaggagatccggtccggcaatgacctgcgtgaacggctgattgcccaggtgaccgcgccagttcgatgggatctctgcatccagcagatcgcggatcgtcagccggaactcgccctatcggcccctccggggaaggtgcaggcgtcgctcttgtctcggcagatcccggacctcgcgacggtctgcatcaccacaccacgggaggcagcccaggctgcacagcggatcgaccagtccgtatccgtccttcagggggcatgatgctcatccccgagtacttcctcacagcctgttcggaccatgctgagcgcctggcgatcatcacccacaatgacgttgtgacgtgggccgaactggcgactcgcgtcgacggttttcggcgctggctgcgggaccatggcgtgcaccgccaggacagggtcgttctccagacgccaagcaccgtaggcacggtagccctcatgtgggcctgcctgctcgacggcgtgacgatggtcccggtgcaccaggacctcactgcctcccaggtgcagcaagtcatcgacgactgccgtccagctctggtgtgtggcagcccggacctcgtccaactcctcaactcccccggaatgaagacaagcacacctccaacgcggccggagtcaacgagtattctgccgtccttgtcccgggtcagccccgatgaccttgcgatgctcatctatacgtccggcacgacgggtctcccgaaggggatcatgtgtccccaccggcaggtcgccaccgccgcacggatcgtccatgactgtctcgggtaccgcacggacgacgtcattctctgtcgcctgccgttgtccttcgactacgggctctatcagattctgatgtctgccatctccggtagcgcggttgtcctgcgggacggaggcgcgcaggaccgcaacctggtgcgcgacatcgcccgtcacggcgtcactgtcgttccagtcgtgccgtccatggcgtcaatgctcatcaccctgcagcgtcgtgatcagttgccgaccatcgtcagactgttcacgaataccggggcgcgtctggcacccgagaccgcgaaccagttgctcgcaagcttccccggctcccgctatgcgtcgatgtatggcatgacggagtgcaagcgcatctccatccttccggtggaggagtacgagacgcatccggacagcgtgggaagagctctgcccagcactcacgtcgagatcgttgacgctcagggagttccggttccggcgggcgagcacggggagatcacggtgtccggcccgaccgtgatgaacggctactggcaggtgccgaacagtcccagtggacgattccgacccagcggccacggcctcactctgttcaccggtgatcgcggctggatggatgaggagggacgtctctacctcctcgggcgcgacgacgagatcgtcaagcatcacggcatccgaatcagcctgcaggagatcgagatagccgccgaagccgcgccgggcgtcgacgcagtcatcgctctcaagccggcctccgactcggcccccattgaaatcgcctactgcggcagcacgagtcccgagaacctggcccgccatctcgaaaccgtcctggaccgggcgcgacgaccccaattcatccaccaactccagcagatccccctgacccgtaacgggaaaccaaaccggtcagcagccgccgaggccatccgctcaagggcgtgacggcgaaggccaacacccacagacgaaaggaaaccaccatgacccaggccgagttcaaccagttcatcgagtccacctgctccgcgacgatcgtggatcccgaccgtcctttggtcgatcagggcatcgactccctcggaatgctcaccctcatggtcgctatcgaggacagcctcggcatcgaactggatcccgagtccctcgccgacggtaggggttccacgccctccggtcttctgtcccttgtcgagcagctgaaagcgacggtgtgacgacatgacgacgatggttccttgccgccgtgtggagatgccgcaactgttcgaccacatccccggaagcatctctctctcaggagggctgcccgatctgagcgtgctcccgagcaatcagatcgccgaactgacgtcccggatcatgcgtctcggctcaagaatcctcctgcaatactccaccccttcggtctcgtcctccttggtgccggccatcctggacctggcggaacgaacatgcatgtcaccggatccgcggaatctgatcccgaccgcgggttcccaactgggcctggccatggtgatcaatgcctttgacggcgatgagatcatctgtgactgcgccacctatcccggggcgctggccgccttcgcctctgccggcgtggaaacaacgggggtggccagtgacgaggaggggctcaacccagacgcgctcgctcacgccgtcgcagagggtcgggccaatggccgccgcatcgcagccgtctacaccacgcccaccttccagaatcccaccggctccgtacagtccgagaaccgccgtgcggccctgctcaaggtgtgtgctgacaatgacctcctcctcatcgaggacgatccgtacggcatgctgtccttcgacgggcagacgtggccagctctgaagtccatggacccacagcgcgtcatctacctgggcaccttctcgaaggtgttcgcaccgggcgtccgttccggctggatcgatccgcccgccaatcttgtcgagaaactccgcgctgtgtgcgagatcatgacactctcgccatcagccctcaaccaagcgatcatcggcgagtaccaccgtcgtcacggatgggacgaactgttggagggctatcgcgcctcctaccgcgaccgagcccgtctcctcatcggggctctcgaggctgaactggcaagaacgaattgcactggcacgtggacctggcgtgaaccacggggcggcttctacctgtggttggagaacgtcgccagcaccagcggtatcgacgttgcgcgtcgcgccgccgacaacggagtggccgtggtgcccgggaaacacttcgacgcagccggacacgattcgccgagcctgcgggtgtcgttcagcaattcacgcccggctgatctggtcgaaggagctcgtcgtctcgcccgtgcactggtgggagaggacgttcagaaatgactctcgcgacacgcaccgccaccgacaccctgcagcagaccttgccctggggcacccacgaacgtctcgtcttcgggcgggcgctcctgcgcagcaccggcttcccagccgaaggcttggccctgctcgactccgacgacatcctccccctcctcgactcctttcttgccggggacatcgacagaactcacttcgagaaggaatacaccagtcgcgaggagtccggcgcaagggcgctcatcaacgtcttgaaggacgatgcagtatcgcgcgccatcgcatggcagaaccccaccgcgtggaggtccttcgaatccctgtcgtccacgagcggaatcaatgcttcgactcggcgcaaggtacgccaactcgccctctactggcaacgttactgttccaaggctgagaccattggatacttcggcccgttcgcctgggccgaagtcgacccggaggcctctgcggtcgaattcatctcctccgaccatctgatcgaccgttcccacgtcgcaatggaggcgtgggcggtcattgagatcgggaaagccctggcatcacgggccgaccttcagtggtggatgccaccaatcctgtcccccgccgtcgacctcaacatggagagaggcaccgtgacggtggctggacaccagccacgacgggtccgggaggacgaggcacgagttctcttcctgaccgacggcacccgtcccgccgcccagatcgccaagagcctcgacatggagcccgagcggttgcgcaggatcctcgtggcccatgaacgtcgtcacaccgtgatctgggacgccaacatccctgtctcagtgcacgcgtgggacatcctgcacgaacgcattgcccagatcggagacgctgggctgcgagatgaggccactgctgttctcacgaggttcgacgagcttctggaggtcatccgcaacattcccgacgcccggtccctgacggaggcgacggaatccctgtcccgtcttttcgaaaccgtgacaggaacctcttcgaacagacgtgcgggccaggcatatgcagcccgcagcctgtgctacctggactgcacccgcgccggaaccgccaaggttgggacccggcttctcgaagccctcgacgcccccctcaacctcgtcctacaatccgctgactggttcgcggcgaccttggcaaaggaatacaccaccgaaatcacggacctcgcaaatcgaaagcagcgggcctcccaccagccactgaccatggctgatgtctggccgtccacgatgtcgctgttctggggggactcaccgtccccactgcagcgagccgtgaccgaactgtcacggcggtggagcagagtcctcgaggggctgcagccagtcgacggtcgcatcgacacgacatcgtccgctctctcgggcgccgtggacgagcagttccccgtgtgcaccccgattccagaactgtcagtgcacagcccggacctccaggtcatcacctcgagcactagcaacatcgcctccggacgagtcactgcagtcatgggtgagctacatgcctgtctgagcagtctcgacatgccgttgctcgagtggtcgctgccccatggttccattcgcgatcgcatcaacaccgcgctcaacctgcgacgtctggttcccttgttccccgagacatggaggcgcaacaccggccgcatggttccagcgacggtcggagtgggggatcgcgcaatcgggttcactcggacggccgatcaagaccgtgcgaacacatggtcgatgtcggcactgctgttcgagcagaccgaggacggactcatgatccgtgatcccgatggcaggctctggaccatcgcacaagcgtggagcgtgcccatctccatggtcgccgccgatgcgttcaagatcgggctgcccggctcaccagcccctcggctcaccattgacaatctcgtcgtgttccgtcgtacctggaggtttcccgctggctccatcgacatcatgcacggttcagccgccgagaaacacgctcggctgagggagtggcaggtcacgaatcaccttcctgaccacctcttcgtcaagttcccctccgaacccaagccgatctacttctccttcgagtcccccgccatggccacggtcttcacgcgatcactgcagcgcgacgcccgagagaatccagacagtctcgtgacgatgtccgaagcactgcccgagcctcaatcctcatggctgcacgacacccggagccaccactacgtccacgaattccggctgcaactgaccaaggagcgacatgacgaccacagttgagacacatcccgaaacacgtggcacaaccgcgacatccatctccaatctgatcggtcacacccctctcgtaagaatggaccatctgttcgacggcctccccttcgaggtgtacggcaagctcgagaagctcaatcctggcggaagcatcaaggatcgagcagcacaatccatgatcgaacgggcaattcgacggggtgagatcgtcccgggccgtacgaccgtcatcgagtccagttcgggaaatctcggcatcgccgtggcgatgctgtgccaggagcacggcctgaatttcatctgcgtaaccgatgccaaggccacgccaacgaacattcgactcatcgaagcgttcggggccactgttgaggtgatcgaagaacctcatcccgagagtggcgaattcctccccatgaggctcaagagggtaagagaactgctgtcagagattccagatgcatggtggccgaatcagtacgggaaccccgacaatccggcggctcacgagcggactgtccgcgagatcatcgaggcaatcccgcgggttgacacgattgtctgcgcgaccggctcgtgcggaacccttcgcggctgccacgaagcattgcgaaagctgtccccacgcacccgactcgtcgccgtggacgccaagggcagcgccatcttcgacgaggcaggagcaccccatccccgctgtgtcccgggacacggtgcgtcagtgcgaccgccgctgtggcgcgcggggctcgccgaccaactggttctggtctccgacgcggactgcgtcgtgggatgccaggaggccctgcgcaccgaggctcttctcctcggcggatcctcgggagcaattctgacggccattcaccgagtgtctcccacgattcccgctggttccaccgtggtgacgatcctccccgacggcggcgagcgctacatcgacaccatctacagccgctcgtgggtcgactcacacatccccgggctgccctctctcgccgactggggggctcccaaccccgccaattcgtatgacctgaacagaagtgcctcatgaagctctacaccagagagaccgtcgaaactgcgcttgtcgggcgtcatggccaggttctcagtgccgtacagagtgcatacatgctgcattcgacgggagagacatcgctgccattctcaaccttcctccgcccggccgggtatccgaacgatcggatcatcgcacttcccgcccacatcggaggcgacttcgacatagccggtatcaagtggatctcatccttcccggaaaacctcgaccggggccagcaacgagcttcctccgtactcatcctcaatagtctggagacgggatacccgaccgccctgctggagtccagtcagatttcagcaacgcgaacggcagcatcagccgccctggccagcgccaccctccatggctccgaagaccatgtcagcacgattggcatcatcggctgcgggacaatcaatcttgcaacgatcgactacctcttccacgtgcacccccagatcaacgaggtcctctccttcgatctgaggcgggagcgggcccatgagttctcgcacctcgtcaaggcttcgcacccagaggcccgggtccgtgtcgccaaggagcccgacgagattctggccgcaagcaacaccatcgcgatcgccacgaccgactcgagtcattggttggaccttccgccgtggcacgggccggggcaccaagtcgtcctgcacacgtcgctgcgagacctgtcagtgccctcgatcctggcagcggccaacgtcgttgacgatcctgatcacgtctgccgtgaagcgacgtccttggatctggcaactcagcagaccggcaaccgggacttcatcacggggagaatcggagacctccttcttggcgcgccgctgtcctcaagtcctgactcccgtgtcattttctcacccttcgggctcggcatcctcgacctcgcagtcgcctccgtcgtcattgctgccgcctcctcttcagcagtcgagatcaatgggttcgaccccgggaaacacgccacaagcatgattgaggtgaatcgatgaccaccacacagatcaacgacaacacggccgttctgcgcgacgtattccccgccggctccgtcgcattcgtgagcggtgcctcacgcggaattggcgctgcctgcgcgacagcccttgcggccgcgggatgcaacctcgccatcacttatcgaaggaaggagaacgaggcggcacaaatcgccgaatccattgaagccatcgggcgccagtgcatcacaatgcagatggacgtaaccgatgagaaccaagtgaccagagccttccgcatcattcgccagcattacggacgcctggacgccgcggtcttgaactcgggaatcaccagtgacgggcatcttgcaacaatgagccgctccaagtggagctcggtgatcgacacgaatctgaccggaaccttcctctgcacgcgcgaggcgaccaaggccatgtactcgtccggtggctcgatcgtcatggtcgcgtccaccagtggagttgcagggcgaccgggccaggccaactacgcagccagcaagggcggaatcgttgccatgatgaagacgctggccccggaggttgcggcaaagaacgtccgggtgaatgcggtggcacccggcttcattcagaccgacatggtggcggccgttccaaaagcggcactcgcccaggcaatccaacacatccccatgggccgtcttggcctggcacaggaggttgcgtcagccgttaccttcctggcctccccgctcgccgcctacatcacagggaagaccctcactatcgatggcggaatgatcaacggctgaccccaggacccggacacccccagtaccgagaaaggaacaacaatgaccgagatcacccacactgccaacagcatccgaacccgcgccgaggaacgttccaacaaagcttggcgcctgaaggaggagatcatctccaagctcggtctcgagaccaagccagaatatgtctcggacaaccaaccgctcttcggacgtggccttgagatggattcccttgacactctcgaagtcgtcgtcgccgtcaacaatgagttcggagtctcggtcaacgacgacgacgtacaggcgttcggctcgatcaatgccatggtcgatttcatcgaggtgaacgagaagtgagttctcttgcgctcgaggcgccacccaaggacgcccgtaagaaattcgcctacgacagcgatgccatcaagacgatgctcccacatcgttggccgatgctcatgattgatcgcgcctacgacgtcgtcccagggaaatcgggcaaaggcatcaagtcggtcagcgtcaatgagccgttcttcgccggtcactaccctgaccattccatcatgcccggcgtcatgatcgtcgagtcgatggctcaactcgtggccgtcatctacgtagccgaggccattcagaacaatcccggcatgacgtcgcacgacgcacgttcaagcgttggttatctcggcgcgatccatcagatgaagttccgacgcctcgtcactccgggcgaccaactcaccctccacgcccagctcggcgagaaagtgggggctctgcgcgaggtttccgtgagagcactcaatggccgggatgtcgtcgcccagggggaactcgtcgtcaccgagcggtgacacccagccacacacgagaaggaagtcccatgatcgttcgcccctacaggccacgtgatgcggaagcgatcgtacatctctacaacagccattccgactcccccaatccagtgtcgggagggattgttgaggaggagttccagagggagctcgaagaacgtggttcgacagtgttcctagtggccgaggaggccggatccattgtcggcacattcgggatgttccgcacgaatggccgacacaccatggccgatgatgaagtcttcgccgacatgttctatgtcaccccgtcacatcgactctcgacagttccgggacagctaatcactgaagccatcagcgagtgcttcatccagggcatcaacgtgatccgcctcaccgtgaaccccgcgaacatctccgcgctcaaggtttacagaaaagtcggttgtgcctgtctcggggccaccgatgcaggcgaggacgggaacattgagctgtacaacttcatccctctggttcttagggcaaccatcaccaaactcgaccacgattgtattcgagccctggcggacatgacttcgttcgcctgcatcaccgagggacgtccacttgatctgtcccacgacttcatcgtggacgctggacggaagatcgtctcccacagcatccagatcgggcgttcaaccatccacgccatggtcgacacgggctcgaggaccattgtggaggccaccctcgacaaccgcgactgggatgctcctcgccagatcgtcgcccccaccccctgtcagaaccggcccgaggaacagcgaggcaaccctgtccggctggtgcacaagaagcttgaggtcaccttcaacgaaggagtcattgagatcagtacgactggccactggggcccggtcctcgcaatgtcctggccctcctccgtctcgcaccgcgctcacgggtggcgacagggccccgccaagtcgtatcgatgcgagcttctcgagaattgcctcgtcctggatgacgaaggaggagtgaaatgcaccatcagcctcaatgattgccaagtcgcgatccggatggatggtgccccaaaaacggaattgagaatgtaccagtggtgcagcctgcgccagggctatctgacggctgacaccggcatcacgagcttcaaccgggcatccagtgggctcggagtcgccgtccgggactcgtccgagattgtcgccgcgggccttcccgtcatccctgacacaccgatcacatggagtgagggtgacatcacggttcagctcgatccctgcggccgcgcctccctgatccactcgaccctggtggaccgaagaatccacttggacgagtctggctcggcaagtctcaccatgaccgtgtttggtgactcccagccccatcgtgccgacaccgtcgagctgcctcccctcgcggcaggcaccgacaggatcgtcctcaagccggctgccggaggcgtgaccacatggcgcttgggcgccaccaaggtgctcaagtcaccgtggccacacgcccgcgcgctcgggcccaatccgatctggcgagccggcctgtgggtcagtcacgagccggatcgccacgaccgtcgccaaggaatggggtggggtcccgatcatcgcagttggaccctgtcggaagacaccatgaccagtactgacgggacactctcctggcgcttcagcggctcccccgacaccggctggacggtcgacgtcacgacgagcaacacgcacggggagaccgtcgtctggctcaccccggactgcccggcgggcgagaggatccgcacgtctgatcatgccgtgacgaccatgcttgacatctcgaagccatggcagcgctggaccacccgatgcgcaattcctctcagacacgggaagtggttcctcatcgagcctgatcatgacctcactgattcccccgaaatcctcatgcgctctgttcacggggtcctgctcgtcggctgtgtcggacgagcccactccggatccgcttcctggcgctttgccatcacgtcagaactccccacctccaacccaagaagaaacgactacacctcagccgcctgaacccaaccagttggaacacccactacagaagaaatggagcaccaccatgtccatcactgagcagtacaagacccttcgcacctcggtcggcctccacacgcctaccggtcccctggtccgtatcaccggtgatgatcgtctcgagtttctcgacaccttcctgtcccgcgcctcggacttcgtggaccccgacaccactcgggagtgcctcgctctcaccgaggacggccttccgctgacgatcttcctccacatcgagcgcgaggaggagtcatggctccttccccgcaccgccatcgatgcggcgaccctcgccacgtacctcggcaacctcgagaccgatggtgacctgtcaatcgagattgctccagagggttggggagctgtcgctgtcgaggggccgctgtcgtggcagatcgccgaaaaccttctcgacttcgacgtggctggcctcgttcttcacgccgtcacggacgtcgtcgttcccggggcccccgagggatcgaaggcatggctcgcccgggtcggaaccactggggagtacggctacctgctcgtctccaacgttcccgacctcgcccgcacttatctcctcagccgcgccacggagctgggcggtcaggcagtcgacgccgatgctctcgcacgagtccaggccgaggccgggatgccctattacgcgatgggcgtgtgccacctcgatgtcgccgggggtgacctcgcctggctcgtggactggcagcgcatcggcgagttccaaggatccgagaatctgcccacacccgtccgagaccagcgccgactggccgccatcgccctgcccaccggcaaccgcccggaagctggtcagaccgtcgctgccggggatgaggagattggagtggtggtgtacgtcaccccgtccgccaatcccgatgaggaactcgcgttcgcacttctggatgctcctttctggactcccacccttccgttgaccgtcggtgcccacgacgggaccacggtcaccctgccccgcgtcgtggcagcctccagcctcaacaagctggggtgacagcgatgacgatcactgctgagaacgccaccacccgcagcgacattgcccggagcattgcggtgaccggcgtgggactggtcacggcacagggtgaccataccgacgagtgctggaccgaacttgtcgatggggtttgcggaatcaccatgaacgtcacgttcgatgactctggcaccacgattccgtgtgctggcgtggctcccattccgaactctgattcgatcgaccgctgttacctgctcggcgtccatgccatgcgtgaagctctcgagatgagtggcatcgacctggactccgtgggtcgtgatcgcatcggactcgtggtgggctcaagcctcggcgcgatgcccaccttggaggcggctcatcgccgggccattgagaccggcgtgctcgatgccggattggcggcagactcccagctcccctgcgtcgccgaccacctcgccgctgagttcgacatccgtggaccccgcgtcgtgacatcgaatgcgtgtgccgctggtgccgtggcgatcggctacgccgcagaactcctctggtccgacgatgtggacctggtcgtctgtggcggtgtcgatccactggcccagatctctgccaatgggttcacgtgcctgggagctctcgacaatctcccatgcagcccgatggccggttcctccggtctgactctgggcgagggagccgggttcatggtcctcgagagaacagatgcggcggctgccagaggccaggaggtgatggccgaaatcgccggctacggcacaagttgtgatggttaccaccagactgccccggacccgggtggcaatggcgcccgcagctcaatggaggccgccctgcgctcagctcatctcaagccgtccgacgtcagctacgtcaatctccacggcaccggtactccgaccaacgacgccgtcgagccgaaggcactccggtcattgttcaagtccgatgaccttccccctgtcagttcggtgaagggcgccatcggtcacactctcggcgctgctggcgccatcgaggccgtgtgctcgatcaaggccatccacgagggggtcctgccgccaaccgtcaacaaccgcgggcaggcttcccgaactggtctcgacatcgtgccggagtgcgcacgcaaggccgctcccgacgtggtcatctccaactccttcgccttcgggggcaacaacgcatcagtggtcatcaccgcacctcgaggaggcgttcactgtaccgccccggcgcagcttcgcgaggtcggaatctcaggaatggcagctctggcgggaaaggccgccaactcggaggagcttctttcggccctgtcagaagattgtccaatctggatggccgatgagaagacctgggaaggggatgctgtccaaaccggccatgtggacatcaagcgcctgtcccgcacaatcaacccgtccaaggttcgtcggatggaccccttgggaatcatctccagcgcggtggtgactgatctgtatgcccgacacgggaagctgagccgcaaggatgccgaaagcacgggaatcatcttcgcaaccggctacggtcctgtgacggcggtgacgcagttcaatgacgggatcatccgccacggttccgagggtgccaacgccctggtgttcccgaacaccgtggtcaacgcagccgcaggccacctcgcgatgctgaatcgctaccgtggttacacggccaccttggcatgcggtggaaccagttcactcatggcgctgcttctcgctgctcgcgtcgttggccgcggcgctgcggatcgcatcatggtcgttatcgctgacgagtttcccagcattgccgtccaggccgtcgcaaagcttcctggctaccgacacagggttgatggttccggagccgtgctctcggaaggcgcggtatgcgtcctggtggaggccgtcgaagtcgccgaagcacgcggtaccgcccccatggcgctgctacgcggcttcggatcccgtggagagtccgtgggagtcggtcacaccgcatccgatggacgggcttgggccaaggccatggccgctgcactgggccaggccggcctgactgcctccgacgtgtcgaccgtcgtggcggcatcaagcggacatcctcgcgtcgaccgagccgagcaggcggccaggcggatcgtcggactgtccgcaaccgctacgaccttcccaaaggcgattgtcggagaaacacacggatcggctgccgggatcgggctgttcggtgccctgtgcggttcgaggtcagccgcgcaccagaacatccttgtcaacgccttttcccacggcggtggttatgcctcgatggtggtggagtcactgtgaccacgacgcttctgccacgggttgcccagccgggaccgggcgtcagccatgtcgacaccgaccgtcccatcgagtgcatcatcacccaccacccccacatgccgcgtgatcgcggaggccacgccacctccgtgtcaggcaggtacttgctgcgccaagccgcagaactcatgctcggcacggatcctgcgcattgccccgtcgtcgacccttcgcggcgctggtactggcccggaatcaatcttcacggttctgtctcccatgtcccgggctggagcctgacgacgctgagcaccggcggccacatcggggcagacatccaggacttccgggagcgtcccggcgcaatggcattcatcggtgacctggtcaagctgtcgcgatcggcgtcactccgagaattcgcggagtgcgaggccgtcgtcaaggtgtccgaattgactaaggagacgttcgggcacgtgcgactgcccgaatggacacccggatggcgccacgttttcgaggactactgggtctggagtctcgagatgcacgggatgggagtcatcgcactcgcatccgatctcccccgagccattcgctggtggcggtgcgacgccgatgcccgtggccgtctccaggctctccgacccataagcagtcttggaccaggaaggccgtcatgagccggtactcacgtcgaatctcaggcatcgaacgcggctatctcaacgccgcaacccggggcccgcaccccaccatccacacgatgatcgacttcgagggccgcgtccccgccgactgttggcggcacgcatccacgattgcgtcggccgccaaccctggcatgacagtggtccggaggtcgggccgatggacatccgatccagcgggctgtccggttgtgttccacgactggaccgcggaccccaacgacgttgccgacttccacgctgacatggatctcgtgacgggaccatcgtccacgctccacgttttcgagggggcggaacgcacccgaatcaccttggcagcaagccatgccgtgaccgatgggcggggcatcgaacgatttctcgtcgacctgcttgcagcgttggacgagcgtgaacccattggaagccccgacaccctgaccgatgtcgatatcaaacgatccttggagaacagcatcaagccccgacgccacctggccgctgtgcccgccgatgtcctttctccactgggggggaggaagaaccaacgtatatgggcctccaggacgtggcacagtgccccgggagccatgagcggaagaatcgctgccgctgtggccgagatgatcgaccacgccgcaatgatcatcatcccggttgacatccggcggcacgtcccagaggtccgatccacagcaaacctaagtgcccaactgccagtgatcatcaccccgaaccagcgctggcaaagcatccatgggcatctgctcacggaccttgctcgccatcgagaccttgcgatcatcagtgaggatttccgccacaacaatccgttcgcatcgaccttggaggaaagccaggccatcggcctcgatggtgtctatccctgtgccgcaatcatctccgaccacgggaagctcgacctttcaaggttccagaccttggaactcaccccggtctcgatgcgaagcctcccgatgctcgttccctactccgcaatgttcatcagcagttgcaccgtcggcgagaccaccactgtcaccatcgctcatcgcgctgatgacgatcccgattccataaacaccttcttccaccacatcgaatcccagatgtccatctgagccacgtcgtccctggagagcaaacatgaccacccaagatgtcatcaccccgccgcgccccgtcacctcccatgccacggcgaccaggtccgaggctccaccgcgaagcgtcatcagagccatggccatctcgatggtcgcgaccctcatggtcatgctcgacacgaccgtcgtgaacgtgtccttgagcgcgaccaccgcccgcttcgggagcatgggcagcgtgcagtgggtcctcacaagttacctacttgcactgtgcgcgacgatgacggcctccgcctgggtcatcgaccgccttggtccacggctcaccttcatcgcctcaatgaccatgttcctcatcggctcggtgatgtgtgcactgagcgattcagtgtggcaactcgtcactggcaggaccatctccggtgccggagctgggatccttgttccgacagcatccgtcctgcttatccgtggcatcccacgcgaacaacttggcagggtgcaggcactgaatgggagtgtccagttgatcgctcccctgatcggcccgactgtgggcggtctcctcgttgacaggtgcgggggctggccggccatctactgggcgaacgtccccgtagctcttgttcttctgattgaggccgtccgcgtcgatccggacgaaccacacaccgctaagcgccgcctcgatgctctcggcctggtctgtggcagcaccgcgatcgtgctgacagtgcttggtgtctcactcttcggcaggacgtcgcgaaacaccaccttcctgcttacgatcggcgcgcttgcagtcctcgcatgggcgttcttcatcacccacatccgaagggctaccaaccctctgcttgacgtttccctgtatcagaaccctgtctattcatggtccagcttcaacgtagcggtgcttggtttcggtctctacgcccccatggtcgtcatgcccctctatctcgaggcgacgcgccacctcactgccgtccacactggtctggtgatgtcagtggccggcgtcggcgtcattatggccggaatcctgtgcacgaagatcatgggccggatcggtggaggcctcacgatgacagttggcataactctgagcatcatcgccactctgcccctggtccggctgacgaaccacacctcctacatactcctggcagtctgcttggccttgcgtggagcaggaatcagcctgacaatcgtcccagccatgacacgggccttcgagtccatcaagaggacggccatggcggacgcctctgcacagctcaacctgttgcagcgaatcggcgggacaattgcgacagcagtcatcatcgcagttatccaccacgaggccatgctcacccgcggactctcccccacagtgttctcgcacgccaacgtgtggatcctcaccgcgaccgccgtcacccttctgccggccttcgcgcttgcgaaggccgaaagacaacagcaggatctctgagcaccgaggagtactccctcgtagaccctcctctgatctaattgggttcgttccaagtgtgtatctcactccggggagccccgattgctgaaccacatcccgttcaccctggcgagtccctcgtggtacgacgtcccctgggcgcccggatctccgtatctcacaggagatatctcggtcctgccagcggactcgccaaggtggacgacgaccatccggggtccttggcaaatccacatgccacctcgtccgacccttccagaggtggggtggaaagtgcatgtgtctgccaagccatcggaattggaatcggttgcctcagtcgtagcactgtggtgcgtacgccacagcgtccccttcaaagtacttcgcacccgaggtctcgttcacgcgagtcaagtcaagtatgcggaccgaagtcagagcggcaaggtctgcacctgctaccccgacggcgagagccttgagcacttctgctccggtcttgccgagctgcttcagaacgtcgattcacctccggtgtccggcgagctgcgagtcggatcctcccctctgtggttgcgtcacgggagtttccgagaggcatgggcggtgtcatccacaggagtaccgttcccggtctacccgggaacaacacatcctgatcgtcgaggccccgcgcccgcagaatccgatcacgacacgccgtggatccggaggctccgtcggacgaatcgccccagcacggttcttcccatcgacgatgtcagactcctccaccaatcaaatgctggcggcgtgtatcaggcaacatggagagacggcacatcggtagtcgtcaaggaggcccggcacctgtccggacttgatgcggcgggtgtcgacgcccgagtgcggctgcgtcacgagtacgaggccctgagaagactggacccctatcgggccgctccccatcccattgatctcattgagaccgaggacggctcgttcctgatcatggaattccttgacggaatgacagtccaccaggagatgtcgaggttccatcctctgattggtaggcgacctcatcggctatcgatgaccgatttttcacgctggtgccgagaggtcgaagatcgcttgaggaatgtcacgagggtcatggccgggtgcggaatcgttcacggggatcttcatcccgcgaatctgatacatgtcggccatgaggttttggttactgactttgaatcctgctcaatcgacggggtcgccgtctcgtcagggatcgccgctccctggttccagtcggacgacacgattcccgatccggcgacgactgacgatctccacactcttctcgtggatccgacttgcggccccgcgcttgtcctccatccaaatcttcgcgcgctcatcagccaggccgcagtcgaggacatgatgggaaatccgactggtttaccacatgcctggaacctcgaggacgtgacaagcgaactcgccaaggggatccgggcatcagccactcccgcacgagccgaccgcctctttccctcagacccctacctgttcgggcatccaggttcagaattcggcctgatgcatggcgccgccggaatcatggctgctcttgccgtgactgggtacggtgttgacgcgaatcacgtgacctggatgaaggaccgcttggccacccgcccgaccctgctgccggggttggccaacggaatcgagggaattgccctgggtctctccctgtgcggtcagaacgacatggctgcatccctgctccaccagtccggaattctcacgatcacaacgaacggatcgactgacctcaccctcggtactggtatggcgggccgagcgtgcgcgctgcagtccctctcacaacgactgtcatcgaaatctctcgcccacgctgcatgtaccctctgggaacaactcgccgtggctgtgcggaacactgatgtggccttgccgaacggcctgttctccggttgggaggggatcgggctctccctgcttgcctctcccctgccggatcgtcatgatctcgcccgccactcactccgactggccctggccacgacaacgattgttgacggtgcgctcttctcaggcgagggacagatccgatggccatatctggggcgtggtcccgcggcatgtggcccgctcgccgccaggcttgatgatgaccagacggccaaggccgtggcacagacctgtcgttgtcccctgactgagtcatccggtctccacaatggccgcgcaggtctcctactcgtcctccgccagctcgtgggagaccaagacgacgccgttcgccgccacctcatgagactgtcgtggtcgatggaccgtcgcgaggaaggcacattgctgctgggtgatcatggcctgcgtttctcatccgatctcgcgacggggtcagccggcgccctcctcgccctgagcagggacccatggcggaacatgacacgaatgctcggaatatgcgatgacacctgtcatggcccactagtgacagtttgatctagcgccgatagttcacaactgaaagactccaaacatcgaggaaaacatgctgagccaaaacgccttggcaggcgtggctcgtttcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttgatcgtgtgagacgccgtcgactaccctgtcccccgtggtacgcacacgccccgtcctggacagtcccggaagaccgctcatcgcctccggagtcgtcctggcggtcctgctcatcatcgcggtgatgacgatggtgcttcagcgcgaccccactctcacccccggacgccgcattctcggtatcgtcctgtccacggtccaggccgtcggattcatgtggctgcagacccgcatggttcgtcacggcaagggttcgcgcaacatgcgtgcgacccttggaagggtcggtttctgggccacgtggggactcgtcgcagtgggagtcgtcaatctgtggctgaccaactcgtggaccctcttcggggcctccgtcgccacgcccctccttctcctgccaggggtgtggagtgtggtggccaccctcgtgaccctgatcgtcggtttctccgacctcgtggtcacccacacctcgccactgacctcagccacggtcgtgctggtgaccatcgcggtgtcggtgaacctctacgcattcacgaagctgtcgacggcactcgttgaactccgctcctcccaggaggagatcgcccggctgcgcgtggacgccgagcgtcaccggatatcgcgggacctccacgacatcatcggtcgcaccctggtcgccacgtcgatgcgccagcaggcggccctccacctcgtcgaccgcgacccgcaacgggccaaggaacagctcgacgccgcccatgacgcaatcaccgaggggcagcaccagttgcgttccatcatccaggccgagatgagcaccagcctccccgacgagatcagcgacgccacattcctgtgcgaccgactccacatcgacttccgcatggatgaccgcggcagaccgcacaaacccttcgactcggcggcggcggcggccctgcgcgagggaatcacgaacatgctcaagcacagcgcggcgggctactgccacgtcgccatctccccggacctcctgaccgtcaccaacgacggttgtccgcaatcacctcgcccctccaccacaccgggcaccggaatcgaccatctccggtcccagatcgaggcgctcggtgggtcggtgacgacgtcgcggccctcgcggggcaccttccggctccgctgctccttcccgacccggggggcgtccacgaccacacccgcgaccgaaggaggacgatgacgacgagaatcctcctcgccgaggacatcaaactggtggcagaggccttcgaggcactgctctcggtggaaccggagttcgaggtcgtcgcacgggtggcacgcggcgacgacctggtcacatccgccacccgcctgttccccgacgtgatcctggccgacatcgacatgcccgggatgaccggcatcgaggccacccgaatgcttcgcgacaagggataccgcggcagaatcatcctgctcaccgccctgccgggaagcgggcacctgcacgccgcgatggctgccggagccgacgggtacctgctcaagtcgatcaccgcgccctccctcatcaacgccatccgggcggtgtgcaacggccagtcggccatcgacccgaacgtcgccgcggtcgccatgcgcaagggaccctcgcccctcaacgaccgggaaaccgagattctgcgcctagtcgccgacggttcctccaccgcgcagatcgcctcgcggctgtacctcagcaagggcaccgtcaggaactacctgtcgacggcgatgtcgaagctcgacgccgactcacgcacagcggcggtcacgcgggcacgcgaggagggctggctgtagcaggcgacccgctcagcccaccgcccctcagcccaccgcccctcagcccgccgactcctgacgcacggcctcctcgaccgcccagctgagcagggacccggccctgaccatcgacgtctccgggtccggctcgaggtcggacaacgcgatgatccggtcgaacgcggaccgtttctcctcgggcaggtcacagcgtccgcacaccgcccagacgggcaccccggcgtcccgggcgatcttgcggatggtgtcgagaagcttgccgagcagggtctgctggtccagccgcccctcccccgtgacgacgagactggaggcggagatccgcgacaccgcgcgggaccatcccaggacgaccgccgcgcccgggcggtacctggtccccaggcacatcagcgcccagccgacccggctgggcggctgcgaaccccctggccaccgcccggcaggcctttcccgaactcagcgaccccttgaaggagtcgacggcaacgatgaccggcgcattcggatcaggacgcatgggatcagcatgtcacgtcgatacggagcagtcgcgccgcctacccctagactcgggggcatggtcaaccgagtctacctgtccctgagcgttctcgccctcgtgctgtgggtggtcgcctaccgtcacatgccgggctgggccgcgggcatcaccctggtgggcatcgtcgtgctgtcgctgtggtgcgagtggtcgcgggtgcgcaccctggccaggatcggcaagtcccgccagcagggcccccgctcctcccgaggacgcaacctgtcgtgagcaatacgattcccgcagccctccaccccggccctgacgaggcc

SEQ ID NO: 435 - DNA, 20 bp, Artificial Sequence
  source: /note="Description of Artificial Sequence: Synthetic primer"
agrgtttgatcmtggctcag

SEQ ID NO: 436 - DNA, 22 bp, Artificial Sequence
  source: /note="Description of Artificial Sequence: Synthetic primer"
tacggytaccttgttaygactt

SEQ ID NO: 437 - DNA, 18 bp, Artificial Sequence
  source: /note="Description of Artificial Sequence: Synthetic primer"
tgtaaaacgacggccagt

SEQ ID NO: 438 - DNA, 18 bp, Artificial Sequence
  source: /note="Description of Artificial Sequence: Synthetic primer"
caggaaacagctatgacc

SEQ ID NO: 439 - DNA, 20 bp, Artificial Sequence
  source: /note="Description of Artificial Sequence: Synthetic primer"
ccgtcaattcctttragttt

SEQ ID NO: 440 - DNA, 32 bp, Artificial Sequence
  source: /note="Description of Artificial Sequence: Synthetic oligonucleotide"
catggcctgcacaccaggcgcttttagcacct

SEQ ID NO: 441 - DNA, 32 bp, Artificial Sequence
  source: /note="Description of Artificial Sequence: Synthetic oligonucleotide"
ggcgtatgacgagttgtggtcggcgtttcctc

SEQ ID NO: 442 - DNA, 32 bp, Artificial Sequence
  source: /note="Description of Artificial Sequence: Synthetic oligonucleotide"
cggtgttaacggcttgcctggcttggatggag

SEQ ID NO: 443 - DNA, 33 bp, Artificial Sequence
  source: /note="Description of Artificial Sequence: Synthetic oligonucleotide"
cgcctaccgtcagctgactcacgcctccgcgtt

SEQ ID NO: 444 - DNA, 33 bp, Artificial Sequence
  source: /note="Description of Artificial Sequence: Synthetic oligonucleotide"
tcacaccagtcatcagcgtcatagtcctctcgg

SEQ ID NO: 445 - DNA, 33 bp, Artificial Sequence
  source: /note="Description of Artificial Sequence: Synthetic oligonucleotide"
ggctcagccctgcccgatgcctacgccaaatgg

SEQ ID NO: 446 - DNA, 33 bp, Artificial Sequence; identical to SEQ ID NO: 444
  source: /note="Description of Artificial Sequence: Synthetic oligonucleotide"

SEQ ID NO: 447 - DNA, 33 bp, Artificial Sequence
  source: /note="Description of Artificial Sequence: Synthetic oligonucleotide"
caccgggcccatcccggtcggcctcctgaaagg

SEQ ID NO: 448 - DNA, 33 bp, Artificial Sequence
  source: /note="Description of Artificial Sequence: Synthetic oligonucleotide"
gatcgagttggctgagtcgaaggtgttgcggtt

SEQ ID NO: 449 - DNA, 33 bp, Artificial Sequence
  source: /note="Description of Artificial Sequence: Synthetic oligonucleotide"
ctgctcatcgctcagctcctgcgcctcatcaca

SEQ ID NO: 450 - DNA, 33 bp, Artificial Sequence
  source: /note="Description of Artificial Sequence: Synthetic oligonucleotide"
ctgcgccaacagccgcatctgatccgaatacgg

SEQ ID NO: 451 - DNA, 33 bp, Artificial Sequence
  source: /note="Description of Artificial Sequence: Synthetic oligonucleotide"
cgcagcaatctcagaaggccacaacaagttcgt

SEQ ID NO: 452 - DNA, 33 bp, Artificial Sequence
  source: /note="Description of Artificial Sequence: Synthetic oligonucleotide"
caaatcacccaagcccaacacgccgccaccacc

SEQ ID NO: 453 - DNA, 33 bp, Artificial Sequence
  source: /note="Description of Artificial Sequence: Synthetic oligonucleotide"
tgtcaccgattcaatgtatctatgagtggtgta

SEQ ID NO: 454 - DNA, 33 bp, Artificial Sequence
  source: /note="Description of Artificial Sequence: Synthetic oligonucleotide"
ttgggtgggtgaggtcgggtcgtcagtcatgag

SEQ ID NO: 455 - DNA, 33 bp, Artificial Sequence
  source: /note="Description of Artificial Sequence: Synthetic oligonucleotide"
gtcgatgtcgagattggcctgggggtccatgtc

SEQ ID NO: 456 - DNA, 33 bp, Artificial Sequence
  source: /note="Description of Artificial Sequence: Synthetic oligonucleotide"
acgtcgtgaacgtaccccttgacggagacggca

SEQ ID NO: 457 - DNA, 33 bp, Artificial Sequence
  source: /note="Description of Artificial Sequence: Synthetic oligonucleotide"
cgagggctaccacgtggtcgatttggactgtcg

SEQ ID NO: 458 - DNA, 33 bp, Artificial Sequence
  source: /note="Description of Artificial Sequence: Synthetic oligonucleotide"
caggcgctccactccctcgccctggccaccaac

SEQ ID NO: 459 - DNA, 33 bp, Artificial Sequence
  source: /note="Description of Artificial Sequence: Synthetic oligonucleotide"
ctatgtggacagtgttggttactgtggggggaa

SEQ ID NO: 460 - DNA, 33 bp, Artificial Sequence
  source: /note="Description of Artificial Sequence: Synthetic oligonucleotide"
gcactgcaccgatatcgtcgtggctgtcacttg

SEQ ID NO: 461 - DNA, 33 bp, Artificial Sequence
  source: /note="Description of Artificial Sequence: Synthetic oligonucleotide"
cccagacaacctcgacaacctgttcaggggatg

SEQ ID NO: 462 - DNA, 33 bp, Artificial Sequence
  source: /note="Description of Artificial Sequence: Synthetic oligonucleotide"
catggctagcccggatttttggctgcctgagcg

SEQ ID NO: 463 - DNA, 33 bp, Artificial Sequence
  source: /note="Description of Artificial Sequence: Synthetic oligonucleotide"
cggcctgcggcagatttttgttgcgttgaatcc

SEQ ID NO: 464 - DNA, 33 bp, Artificial Sequence
  source: /note="Description of Artificial Sequence: Synthetic oligonucleotide"
cgggcagaggatgtgttgctcgttcctggatgg

SEQ ID NO: 465 - DNA, 33 bp, Artificial Sequence
  source: /note="Description of Artificial Sequence: Synthetic oligonucleotide"
gttacgctggaacccccaatgaacacgcgagaa

SEQ ID NO: 466 - DNA, 33 bp, Artificial Sequence; identical to SEQ ID NO: 457
  source: /note="Description of Artificial Sequence: Synthetic oligonucleotide"

SEQ ID NO: 467 - DNA, 33 bp, Artificial Sequence; identical to SEQ ID NO: 458
  source: /note="Description of Artificial Sequence: Synthetic oligonucleotide"

SEQ ID NO: 468 - DNA, 20 bp, Artificial Sequence
  source: /note="Description of Artificial Sequence: Synthetic primer"
agagtttgatymtggctcag

SEQ ID NO: 469 - DNA, 22 bp, Artificial Sequence
  source: /note="Description of Artificial Sequence: Synthetic primer"
tacggytaccttgttacgactt

SEQ ID NO: 470 - DNA, 21 bp, Artificial Sequence
  source: /note="Description of Artificial Sequence: Synthetic primer"
gataatccgttcgacaagctg

SEQ ID NO: 471 - DNA, 19 bp, Artificial Sequence
  source: /note="Description of Artificial Sequence: Synthetic primer"
acccaccacgatgatgttt

SEQ ID NO: 472 - DNA, 20 bp, Artificial Sequence
  source: /note="Description of Artificial Sequence: Synthetic primer"
cgacgcctccaataacttcc

SEQ ID NO: 473 - DNA, 18 bp, Artificial Sequence
  source: /note="Description of Artificial Sequence: Synthetic primer"
gtcggcctcctcagcatc

SEQ ID NO: 474 - DNA, 18 bp, Artificial Sequence
  source: /note="Description of Artificial Sequence: Synthetic primer"
ccggagacaacgacaggt

SEQ ID NO: 475 - DNA, 23 bp, Artificial Sequence
  source: /note="Description of Artificial Sequence: Synthetic primer"
gcttcctcataccactggtcatc

SEQ ID NO: 476 - DNA, 33 bp, Artificial Sequence
  source: /note="Description of Artificial Sequence: Synthetic oligonucleotide"
catctgccaacgagcgagagtggcgcggtgttc

SEQ ID NO: 477 - DNA, 33 bp, Artificial Sequence; identical to SEQ ID NO: 457
  source: /note="Description of Artificial Sequence: Synthetic oligonucleotide"

SEQ ID NO: 478 - DNA, 33 bp, Artificial Sequence; identical to SEQ ID NO: 458
  source: /note="Description of Artificial Sequence: Synthetic oligonucleotide"

SEQ ID NO: 479 - DNA, 33 bp, Artificial Sequence
  source: /note="Description of Artificial Sequence: Synthetic oligonucleotide"
ctgactggtttgggtcatacgtcttctgacacg

SEQ ID NO: 480 - DNA, 33 bp, Artificial Sequence
  source: /note="Description of Artificial Sequence: Synthetic oligonucleotide"
tcacaggccacgcaggcacatcacccttattag

SEQ ID NO: 481 - DNA, 33 bp, Artificial Sequence
  source: /note="Description of Artificial Sequence: Synthetic oligonucleotide"
ctccccctcctccccgggaggaaaagcagacca

SEQ ID NO: 482 - DNA, 33 bp, Artificial Sequence; identical to SEQ ID NO: 457
  source: /note="Description of Artificial Sequence: Synthetic oligonucleotide"

SEQ ID NO: 483 - DNA, 33 bp, Artificial Sequence; identical to SEQ ID NO: 457
  source: /note="Description of Artificial Sequence: Synthetic oligonucleotide"

SEQ ID NO: 484 - DNA, 33 bp, Artificial Sequence; identical to SEQ ID NO: 458
  source: /note="Description of Artificial Sequence: Synthetic oligonucleotide"

SEQ ID NO: 485 - DNA, 69 bp, Propionibacterium acnes
caaccgtagatacagatacatctgaggagatccatgaagaaaaaccgcgcctcaggttcgcaatgaaga

SEQ ID NO: 486 - DNA, 69 bp, Propionibacterium acnes; identical to SEQ ID NO: 485

SEQ ID NO: 487 - DNA, 69 bp, Propionibacterium acnes; identical to SEQ ID NO: 485

SEQ ID NO: 488 - DNA, 69 bp, Propionibacterium acnes; identical to SEQ ID NO: 485

SEQ ID NO: 489 - DNA, 69 bp, Propionibacterium acnes; identical to SEQ ID NO: 485

SEQ ID NO: 490 - DNA, 69 bp, Propionibacterium acnes; identical to SEQ ID NO: 485

SEQ ID NO: 491 - DNA, 69 bp, Propionibacterium acnes; identical to SEQ ID NO: 485

SEQ ID NO: 492 - DNA, 69 bp, Propionibacterium acnes; identical to SEQ ID NO: 485

SEQ ID NO: 493 - DNA, 69 bp, Propionibacterium acnes; identical to SEQ ID NO: 485

SEQ ID NO: 494 - DNA, 62 bp, Propionibacterium acnes
caaccgcagatgcatctgagaagatccatgaagaaaaacccgcctcaggttcgcaatgaaga

SEQ ID NO: 495 - DNA, 62 bp, Propionibacterium acnes; identical to SEQ ID NO: 494

SEQ ID NO: 496 - DNA, 62 bp, Propionibacterium acnes; identical to SEQ ID NO: 494

SEQ ID NO: 497 - DNA, 62 bp, Propionibacterium acnes; identical to SEQ ID NO: 494

SEQ ID NO: 498 - DNA, 62 bp, Propionibacterium acnes; identical to SEQ ID NO: 494

SEQ ID NO: 499 - DNA, 62 bp, Propionibacterium acnes; identical to SEQ ID NO: 494

SEQ ID NO: 500 - DNA, 62 bp, Propionibacterium acnes; identical to SEQ ID NO: 494

SEQ ID NO: 501 - DNA, 62 bp, Propionibacterium acnes; identical to SEQ ID NO: 494

SEQ ID NO: 502 - DNA, 20 bp, Artificial Sequence
  source: /note="Description of Artificial Sequence: Synthetic primer"
gcaacccgacatcctcatta

SEQ ID NO: 503 - DNA, 20 bp, Artificial Sequence
  source: /note="Description of Artificial Sequence: Synthetic primer"
agtcgaagaagtcgctcagg

SEQ ID NO: 504 - DNA, 22 bp, Artificial Sequence
  source: /note="Description of Artificial Sequence: Synthetic probe"
cgttctacagccaccacgacgg

What is claimed is:

1. A method for treating acne in a subject in need thereof, comprising: administering an effective amount of a composition comprising an RT6 strain of *P. acnes* to the subject.

2. The method of claim 1, wherein the strain has at least 99% homology to SEQ ID NO: 6.

3. The method of claim 2, wherein the strain has at least 100% homology to SEQ ID NO: 6.

4. The method of claim 1, wherein the strain has at least 95% homology to SEQ ID NO: 51, SEQ ID NO: 52, SEQ ID NO: 53, or SEQ ID NO: 54.

5. The method of claim 4, wherein the strain has at least 99% homology to SEQ ID NO: 51, SEQ ID NO: 52, SEQ ID NO: 53, or SEQ ID NO: 54.

6. The method of claim 5, wherein the strain has at least 100% homology to SEQ ID NO: 51, SEQ ID NO: 52, SEQ ID NO: 53, or SEQ ID NO: 54.

7. The method of claim 1, wherein the composition is formulated for topical application.

8. The method of claim 7, wherein the composition is formulated as a cream.

* * * * *